United States Patent
Zender et al.

(10) Patent No.: US 10,441,577 B2
(45) Date of Patent: Oct. 15, 2019

(54) MEDICAMENT FOR TREATMENT OF LIVER CANCER

(75) Inventors: Lars Zender, Braunschweig (DE); Ramona Rudalska, Braunschweig (DE); Daniel Dauch, Braunschweig (DE)

(73) Assignee: HELMHOLTZ ZENTRUM FUER INFEKTIONSFORSCHUNG, Braunschweig (DE)

(*) Notice: Subject to any disclaimer, the term of this patent is extended or adjusted under 35 U.S.C. 154(b) by 256 days.

(21) Appl. No.: 14/131,059

(22) PCT Filed: Jul. 9, 2012

(86) PCT No.: PCT/EP2012/063445
§ 371 (c)(1),
(2), (4) Date: Apr. 10, 2014

(87) PCT Pub. No.: WO2013/007708
PCT Pub. Date: Jan. 17, 2013

(65) Prior Publication Data
US 2015/0079154 A1     Mar. 19, 2015

Related U.S. Application Data

(60) Provisional application No. 61/508,368, filed on Jul. 15, 2011.

(30) Foreign Application Priority Data

| Jul. 8, 2011 | (EP) | 11173379 |
| Mar. 23, 2012 | (EP) | 12161141 |
| Apr. 2, 2012 | (EP) | 12162905 |

(51) Int. Cl.
| A61K 31/4412 | (2006.01) |
| A61K 31/4439 | (2006.01) |
| A61K 31/513 | (2006.01) |
| A61K 31/5513 | (2006.01) |
| A61K 31/5377 | (2006.01) |
| A61K 31/519 | (2006.01) |
| A61K 38/08 | (2019.01) |
| A61K 31/713 | (2006.01) |
| A61K 31/444 | (2006.01) |
| A61K 45/06 | (2006.01) |
| A61K 31/44 | (2006.01) |

(52) U.S. Cl.
CPC .......... *A61K 31/4412* (2013.01); *A61K 31/44* (2013.01); *A61K 31/444* (2013.01); *A61K 31/4439* (2013.01); *A61K 31/513* (2013.01); *A61K 31/519* (2013.01); *A61K 31/5377* (2013.01); *A61K 31/5513* (2013.01); *A61K 31/713* (2013.01); *A61K 38/08* (2013.01); *A61K 45/06* (2013.01)

(58) Field of Classification Search
None
See application file for complete search history.

(56) References Cited

U.S. PATENT DOCUMENTS

2012/0108641 A1   5/2012  Demers et al.
2012/0115862 A1*  5/2012  Laufer et al. ............. 514/232.8

FOREIGN PATENT DOCUMENTS

| CN | 101 317 832 | 8/2011 |
| WO | WO 2000/042012 | 7/2000 |
| WO | WO 2005/009961 | 2/2005 |
| WO | WO 2010/128259 | 11/2010 |

OTHER PUBLICATIONS

Abou-Alfa et al. (JCO Sep. 10, 2006 vol. 24 No. 26 4293-4300).*
Balkwill (Cancer and Metastasis Reviews Sep. 2006, vol. 25, Issue 3, pp. 409-416).*
Wagner et al. (Nature Reviews Cancer vol. 9 Aug. 2009 p. 537-549).*
Liu Cancer Res 2006; 66: (24). Dec. 15, 2006, (Year: 2006).*
Huynh, Hung, "Molecularly targeted therapy in hepatocellular carcinoma", *Biochemical Pharmacology*, 80 (2010) pp. 550-560.
Llovel, J. et al., "6519 Efficacy and safety of sorafenib in patients with advanced hepatocellular carcinoma (HCC): collective results from the phase III sorafenib HCC assessment randomized protocol (SHARP) and Asia-Pacific trials", Joint ECCO 15—34th ESMO Multidisciplinary Congress, Sep. 2009, vol. 7, No. 2, p. 367.
Min, Lihua, et al., "Mitogen-activated protein kinases in hepatocelluclar carcinoma development", *Seminars in Cancer Biology*, 21, (2011) pp. 10-20.
Noel, J. Kay, et al., "Systematic review to establish the safety profiles for direct and indirect inhibitors of p38 Mitogen-activated protein kinases for treatment of cancer", *Med Oncol*, (2008) 25, pp. 323-330.
Parekh, Palak, et al., "Downregulation of cyclin D1 is associated with decreased levels of p38 MAP kinases, Akt/PKB and Pak1 during chemopreventive effects of resveratrol in liver cancer cells", *Experimental and Toxicological Pathology*, 63 (2011) pp. 167-173.
Unknown: "Nexavar: EPAR—all authorized publications", Internet Mar. 4, 2007, Retrieved from the Internet: http://www.ema.europa.eu/docs/en_GB/document_library/EPAR—All Authorised_presentations/human/000690/WC500027706.pdf [retrieved on Nov. 24, 2011] (1 page).
Hui et al, 2007, Cell Cycle 6:20, pp. 2429-2433.
Stepniak et al, 2006, Genes & Development, 20:2306-2314.

* cited by examiner

*Primary Examiner* — Jeffrey S Lundgren
*Assistant Examiner* — William Y Lee
(74) *Attorney, Agent, or Firm* — Dvorah Graeser; Graeser Associates International Inc

(57) ABSTRACT

The invention provides a pharmaceutical composition comprising Sorafenib in combination with an inhibitor of a specific kinase inhibitor as a medicament for the treatment or prevention of liver cancer.

Figure 1:
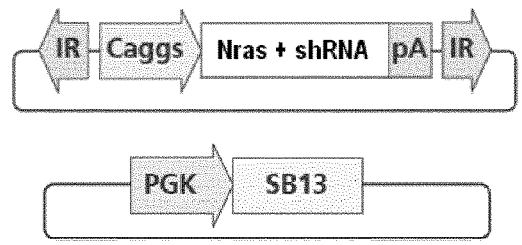

7 Claims, 8 Drawing Sheets
Specification includes a Sequence Listing.

MEDICAMENT FOR TREATMENT OF LIVER CANCER

The present invention relates to a medicament and to a pharmaceutical composition, respectively, which is suitable for the treatment or prevention of liver cancer, especially hepatocellular carcinoma (HCC) in human patients.

Further, the invention relates to a method for the treatment of liver cancer by administration of the pharmaceutical composition to a patient, and to a process for producing a medicament or pharmaceutical composition, respectively, which is suitable for the treatment of liver cancer.

STATE OF THE ART

Today, the only curative options for the treatment of liver cancer are surgical resection or liver transplantation. However, at the time of diagnosis the majority of patients present with advanced tumor growth and are therefore not eligible for these treatment options. Liver cancer is a primarily chemoresistant tumor and only recently Llovet and coworkers described the multikinase inhibitor Sorafenib as the first systemic treatment which can prolong survival of patients with HCC. However, the treatment is costly and only yields a survival advantage of less than three month. Therefore, there is an urgent clinical need for the development of medicaments which increase efficiency over Sorafenib.

WO 2010/128259 A1 describes a pharmaceutical combination of Sorfenib with a vascular disrupting agent.

WO2005/009961 A2 describes a fluoro derivative of Sorafenib.

Huynh et al, Biochemical Pharmacology, 550-560 (2010), describe Sorafenib for use as a medicament in the treatment of liver cancer.

Noel et al, Med Oncol 323-330 (2008) report on studies on cancer treatment using Sorafenib or Thalidomid (Contergan).

Parekh et al, Experimental and Toxicologic Pathology 167-173 (2011) describe that resveratrol treatment down-regulated cyclin D1 and p38 MAP kinase, Akt and Pak1 expression and activity in HepG2 cells, and that resveratrol treated cells showed an increase in ERK activity.

Min et al, Seminars in Cancer Biology, 10-20 (2011), quote that p38α has a negative regulatory role in tumorigenesis, especially of the liver, and that the p38α signalling pathway has a suppressive role in tumorigenesis. Sorafenib is described to inhibit proliferation of HCC cells and to induce apoptosis by inhibiting the phosphorylation of MEK, ERK and down-regulating cyclin D1 levels.

OBJECTS OF THE INVENTION

It is an object of the invention to provide a pharmaceutical composition for the treatment of liver cancer with an increased efficacy. It is a preferred object of the invention to provide for a pharmaceutical composition for use against liver cancer, the composition having an increased efficacy in comparison to a composition containing the same amount of Sorafenib.

GENERAL DESCRIPTION OF THE INVENTION

The invention achieves these objects by the features as defined by the claims, especially by providing a pharmaceutical composition, the composition comprising Sorafenib and, in addition to Sorafenib, an inhibitor of Mapk14 (p38α kinase inhibitor) as a medicament for use in the treatment and/or in the prevention of cancer, especially liver cancer. The inhibitor of Mapk14 activity is a pharmaceutical active agent which in combination with Sorafenib is used as a medicament for the treatment and/or prevention of liver cancer. In the combination, Sorafenib and the inhibitor of Mapk14 can be provided for joint administration, e.g. as a composition containing both Sorafenib and an inhibitor of Mapk14, or Sorafenib and the inhibitor of Mapk14 can be provided for separate administration, e.g. firstly Sorafenib and secondly an inhibitor of Mapk14, or firstly an inhibitor of Mapk14 and secondly Sorafenib. Accordingly, the invention provides a combination of Sorafenib with an inhibitor of Mapk14 as a medicament for the treatment and/or prevention of liver cancer for joint or separate administration, as well as for a composition comprising a combination of Sorafenib and of an inhibitor of Mapk14, e.g. each of Sorafenib and an inhibitor of the activity of Mapk14 contained in a separate formulation for use in separate administration, or a formulation containing both Sorafenib and an inhibitor of the activity of Mapk14 in combination. Further, the invention relates to the treatment of cancer, especially of liver cancer, by administration of this pharmaceutical composition, e.g by separate or simultaneous administration of Sorafenib and of the inhibitor of Mapk14 to a human suffering from cancer, especially from liver cancer. Optionally, the liver cancer is non-viral liver cancer or virally caused liver cancer.

It has been demonstrated during the preparation of the invention that an agent which inhibits the activity of Mapk14 increases the efficacy of Sorafenib, as a medicament in the treatment or prevention of liver cancer. As the inhibition of the activity of Mapk14 can be obtained by the inhibition of the expression of Mapk14 gene product or protein, inhibitors of the translation of the mRNA encoding Mapk14, and inhibitors of Mapk14 protein activity, e.g. kinase inhibitors, are comprised in the group of inhibitors of the activity of Mapk14 which are used in a combination with Sorafenib for use as a medicament for the treatment or prevention of liver cancer.

Inhibitors of the activity of Mapk14, especially of the expression of Mapk14, are comprised in the group of small regulatory RNAs such as small inhibitory RNAs (siRNA), short hairpin RNA (shRNA) and microRNAs (miRNA), having a nucleic acid sequence hybridizing under physiological conditions, e.g. within a liver cell, to the mRNA encoding Mapk14 to reduce or inhibit the presence of Mapk14 in a hepatocyte or a liver cancer cell through RNA interference and accordingly inhibit the activity of Mapk14. Small regulatory RNA molecules comprise or consist of the group containing at least one of the following inhibitory RNAs: SEQ ID NO: 1 to SEQ ID NO: 1364.

ShRNA molecules, e.g. contained in microRNA molecules, hybridize to the mRNA encoding Mapk14. The Mapk14 encoding gene gives rise to four mRNAs, which are regarded as splice products. The splice product mRNAs are given as SEQ ID NO: 1365 to SEQ ID NO: 1368. The shRNA of the invention through RNA interference reduce the expression, and hence the activity of Mapk14 gene product. Alternatively, the inhibitory RNAs can be contained in classical antisense oligonucleotides for targeting the same mRNA regions for suppression of Mapk14 expression.

The specificity of shRNA, especially when the sequence encoding the shRNA was contained in a microRNA can also be shown in an vitro test using the reduction of the expression of a reporter gene product from a fusion gene, which produces a fusion mRNA that contains the coding sequence for both the reporter gene and for Mapk14. In this assay, it can be found that the mRNA of the fusion gene, which mRNA comprises the coding sequence for Mapk14 in combination with the coding sequence for the reporter gene, is reduced in the presence of an shRNA which is specific for the mRNA encoding Mapk14, whereas a control encoding an mRNA of the reporter gene only did not show a reduction of the reporter gene expression in the presence of an shRNA hybridizing to the mRNA encoding Mapk14.

The inactivation of Mapk14 by inhibiting or reducing the expression of Mapk14 in hepatocytes or liver cancer cells in experimental animals, both by suppression of the expression of Mapk14 via continuous expression of an shRNA specific for the mRNA encoding Mapk14 in the mouse model, and by administration of a pharmaceutical composition, in which the pharmaceutical active agent consists of an shRNA specific for the mRNA encoding Mapk14 of the mouse reduces the present liver cancer or prevents the generation of liver cancer upon administration of agents which in the absence of the combination of a Mapk14 inhibitor and Sorafenib would induce a liver cancer.

The reduction or repression of Mapk14 activity by reducing or suppressing the expression of Mapk14 using the continuous expression of an shRNA which is specifically directed against the mRNA encoding Mapk14, or by administration of a pharmaceutical composition containing as the active ingredient or agent an shRNA specifically directed against the mRNA encoding Mapk14 in the animal model reduces a previously established liver cancer with increased efficacy upon administration of Sorafenib in comparison to the treatment with Sorafenib as the only pharmaceutical active agent, i.e. Sorafenib without the combination with an agent reducing Mapk14 activity.

In a preferred embodiment, the inhibitor of the activity of Mapk14 is at least one of the group comprising or consisting of inhibitors which have preference or specificity for inactivating the Mapk14 gene product, which compounds are given in the following table 1. Generally, an inhibitor of Mapk14 according to the invention has an IC50 of at maximum 30 nM, preferably of at maximum 20 nM, more preferably of at maximum 10 nM or max. 5 nM or of at maximum 1 nM, most preferably of at maximum 0.1 or of at maximum 0.01 nM. Preferably, the IC50 is determined in an in vitro assay on Mapk14, e.g. determining the IC50 (inhibitory concentration for 50% inhibition) in dependence on the concentration of the inhibitor. For example, Mapk14, preferably having the human amino acid sequence and human structure, e.g. produced by expression of the human gene encoding Mapk14 in a human cell line, is isolated and incubated in a suitable buffer in the presence of a substrate to be phosphorylated, e.g. ATF-2, MAPKAPK-2 or Hsp27, $^{32}$P-γ-labelled ATP and the inhibitor. The $^{32}$P-γ-labelled ATP is separated from the substrate, and the amount of $^{32}$P-phosphorylation is determined, e.g. using scintillation counting. The preferred substrate are ATF-2, MAPKAPK-2 or Hsp27 and a preferred buffer is: 20 mM HEPES (pH 7.5), 10 mM $MgCl_2$, 1 mg/ml BSA and protease inhibitor e.g. Complete mini (Roche), using incubation at room temperature or 37° C. For comparison, the inhibitor of Mapk14 has a lower IC50 than Sorafenib, which has an IC50 for Mapk14 of approx. 38 nM.

Additionally or alternatively, the inhibitory activity of the inhibitor of Mapk14 is determined in a cell-based in vitro assay using e.g. cancer cells, e.g. Hep3B. In the assay, the inhibitory activity of p38 inhibitors is determined for substrate protein of Mapk14 in relation to a housekeeping gene, e.g. α-tubulin. In the assay, cells are incubated with various concentrations of the inhibitor or carrier only respectively, e.g. for 2-4 days, and protein is extracted, e.g. using NP40-containing buffer. In the extracted protein, phosphorylated substrate protein of Mapk14 is determined, e.g. by immunological detection of phosphorylated substrate protein, e.g. using a Western blot of SDS-PAGE separated cellular protein. For immunological detection, a phospho-specific antibody can be used. A preferred substrate protein is ATF-2, MAPKAPK-2 and/or Hsp27.

Additionally or alternatively, the combination of Sorafenib with the additional inhibitor of Mapk14 of the invention in a cell-based assay has a significant higher toxicity or inhibition of proliferation rate against cultivated cancer cells, especially against liver cancer cells, e.g. against Hep3B. In the assay, cultivated living cells are counted following incubation with a combination of Sorafenib and the inhibitor of Mapk14 or with the same concentration of Sorafenib or inhibitor against Mapk14 alone or carriers, respectively, e.g. at concentrations of at maximum 20 μM, preferably at maximum 12 μm, more preferably at max. 5 μm. Significance can be determined using the two-tailed student's T-test. Preferably, the combination of Sorafenib and the inhibitor of Mapk14 according to the invention reduce cell proliferation of has an inhibitory effect on the cultivated cancer cells higher by at least a factor of 2, preferably at least by a factor of 4, more preferably at least by a factor of 10, in comparison to Sorafenib of the same concentration by itself.

TABLE 1

Inhibitors of Mapk14 activity

| name | Chemical name or structure |
| --- | --- |
| SB 203580 | 4-[5-(4-fluorophenyl)-2-[4-(methylsulfonyl)phenyl]-1H-imidazol-4-yl]pyridine, IC50 = 48 nM |
| SB 202190 | 4-[4-(4-fluorophenyl)-5-(4-pyridinyl)-1H-imidazol-2-yl]phenol |
| SB 239063 | trans-4-[4-(4-fluorophenyl)-5-(2-methoxy-4-pyrimidinyl)-1H-imidazol-1-yl]cyclohexanol, IC50 = 44 nM |
| SB 220025 | 5-(2-amino-4-pyrimidinyl)-4-(4-fluorophenyl)-1-(4-piperidinlyl)imidazole, IC50 = 19 nM |
| SB203580 hydrochloride | 4-[5-(4-fluorophenyl)-2-[4-(methylsulphonyl)phenyl]-1H-imidazol-4-yl]pyridine hydrochloride, IC50 = 50 nM |
| SB 85635 | |
| SB 242235 | 4-[4-(4-fluorophenyl)-1-(piperidin-4-yl)-1H-imidazol-5-yl]-2-methoxypyrimidine::4-[4-(4-fluorophenyl)-1-piperidin-4-yl-1H-imidazol-5-yl]-2-methoxypyrimidine |

TABLE 1-continued
Inhibitors of Mapk14 activity
| name | Chemical name or structure |
|---|---|
| SB 681323 | 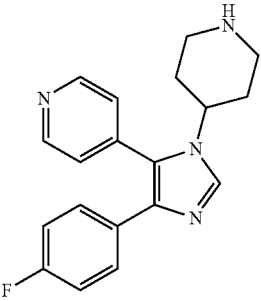 [SMILES: Fc1ccc(-c2ncn(C3CCNCC3)c2-c2ccncc2)cc1] |
| SB 210313 | 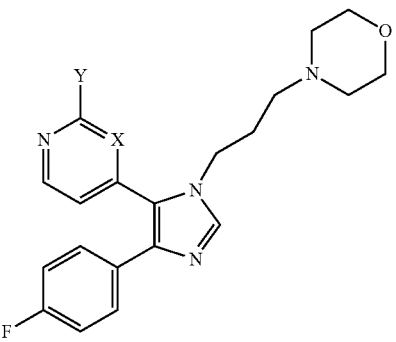<br>X = CH, Y = H<br>IC50 = 1300 nM |
| SB 216385 | 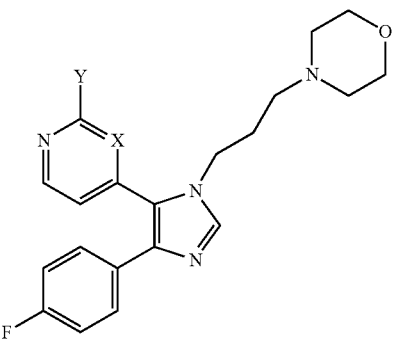<br>X = N, Y = NH$_2$<br>IC50 = 480 nM |
| Iosmapimod (856553) | |
| AW-814141 | 2-(hexahydrocyclopenta(c)pyrrol-2-ylamino)-8-methyl-6-o-tolyl-8H-pyrido(2,3-d)pyrimidine-7-one<br>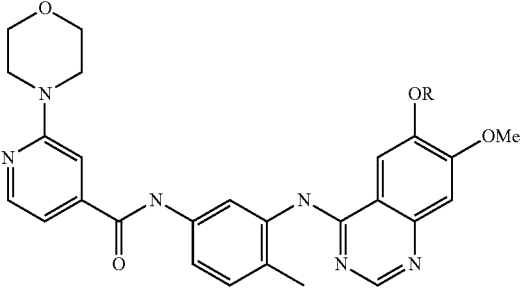 |

TABLE 1-continued

Inhibitors of Mapk14 activity

| name | Chemical name or structure |
|---|---|
| | 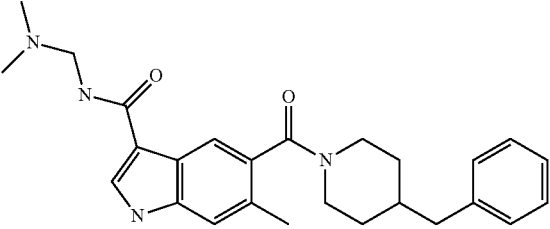 [SMILES: Cc1cc2[nH]cc(C(=O)NCN(C)C)c2cc1C(=O)N1CCC(Cc2ccccc2)CC1] |
| | 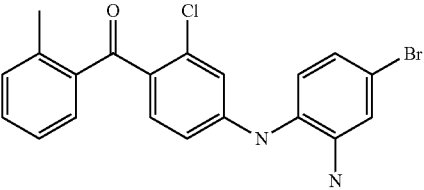 [SMILES: Cc1ccccc1C(=O)c1ccc(Nc2ccc(Br)cc2N)cc1Cl] |
| KR-003048 | 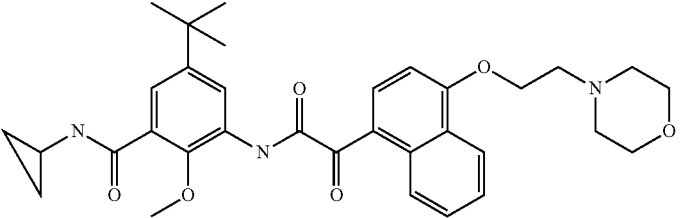 [SMILES: COc1c(NC(=O)C(=O)c2ccc(OCCN3CCOCC3)c3ccccc23)cc(C(C)(C)C)cc1C(=O)NC1CC1] |
| RWJ 67657 | 4-[4-(4-fluorophenyl)-1-(3-phenylpropyl)-5-(4-pyridinyl)-1H-imidazol-2-yl]-3-butyn-1-ol |
| SKF-86002 dihydrochloride | 6-(4-fluorophenyl)-2,3-dihydro-5-(4-pyridinyl)imidazo[2,1-b]thiazole dihydrochloride |
| TAK-715 | N-(4-(2-ethyl-4-(3-methylphenyl)-thiazol-5-yl)pyridin-2-yl)benzamide |
| JIP-1(153-163) | $C_{63}H_{108}N_{20}O_{16}$, corresponding to Arg-Pro-Lys-Arg-Pro-Thr-Thr-Leu-Asn-Leu-Phe-Nh2•AcOH (SEQ ID NO: 1369) |
| LY2228820 | 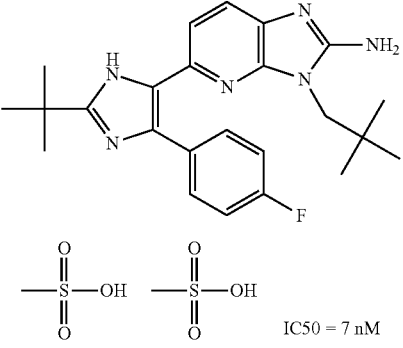 |
| RWJ67671 | 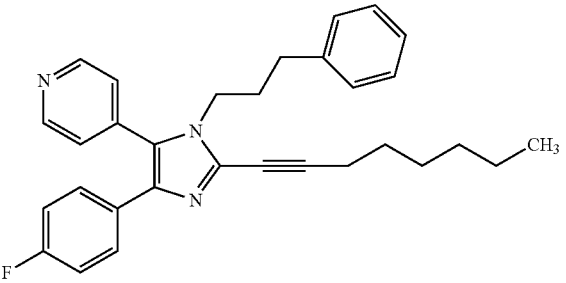 |

TABLE 1-continued
Inhibitors of Mapk14 activity
| name | Chemical name or structure |
|---|---|
| RWJ67568 | 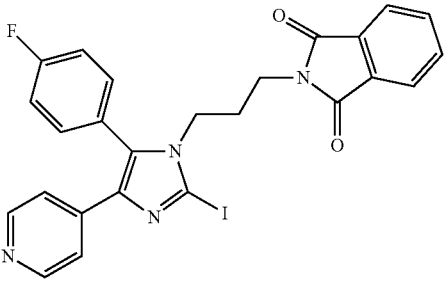 |
| RWJ67411 | 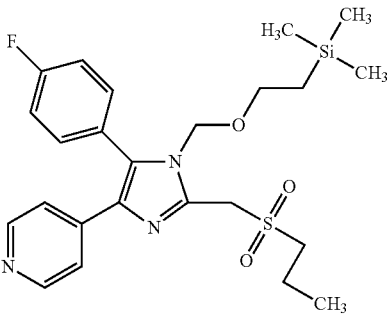 |
| RWJ66430 | 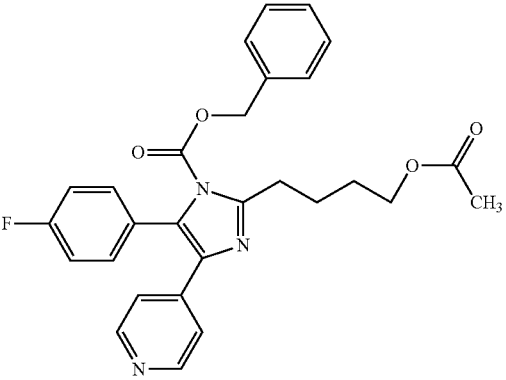 |
| SKF 86002 | 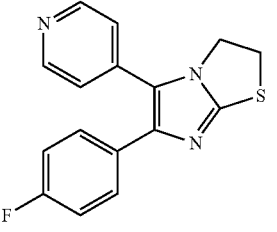<br>IC50 = 1500 nM |

TABLE 1-continued

Inhibitors of Mapk14 activity

| name | Chemical name or structure |
|------|---------------------------|
| L-167307 | 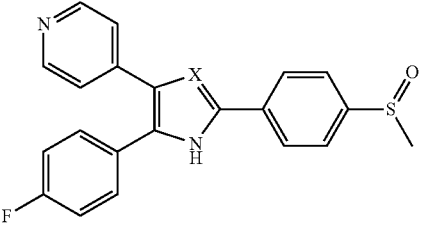 X = CH, IC50 = 5 nM |
| | (second structure, pyrazolone) |
| RWJ 68354 | 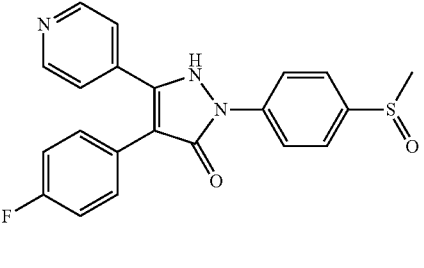 [SMILES: CS(=O)c1ccc(-n2[nH]c(-c3ccncc3)c(-c3ccc(F)cc3)c2=O)cc1] IC50 = 9 nM |
| JX 401 | 1-[2-methoxy-4-(methylthio)benzoyl]-4-(phenylmethyl)piperidine, IC50 = 32 nM |
| SC-68376 | 2-methyl-4-phenyl-5-(4-pyridyl)oxazole, IC50 = 2-5 μM |
| EO 1428 | (2-methylphenyl)-[4-[(2-amino-4-bromophenyl)amino]-2-chlorophenyl]methanone |
| CMPD-1 | 2'-fluoro-N-(4-hydroxyphenyl)-[1,1'-biphenyl]-4-butanamide |
| SD 169 | 1H-Indole-5-carboxamide, IC50 = 3.2 nM |
| R-130823 | 2-(4-fluorophenyl)-4-(1-phenethyl-1,2,3,6-tetrahydropyridin-4-yl)-3-(pyridin-4-yl)-1H-pyrrole, IC50 = 22 nM |
| SD282 | indole-5-carboxamide, IC50 = 0.0011 μM |
| | 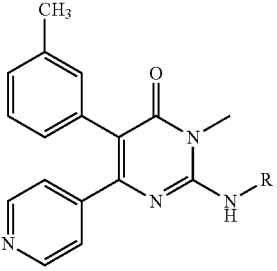 |

TABLE 1-continued
Inhibitors of Mapk14 activity
| name | Chemical name or structure |
|---|---|
| (WO2000031065) | 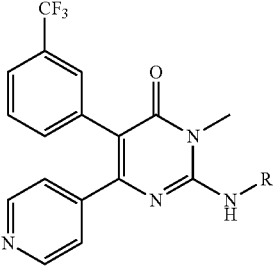 |
| (WO2000071535) | 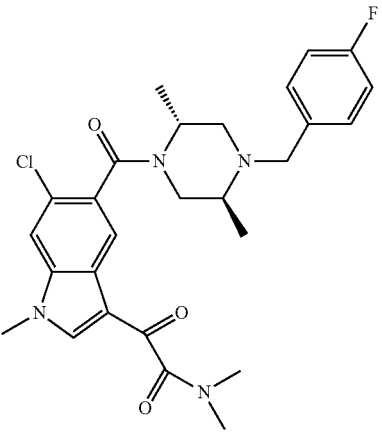 [SMILES: C[C@@H]1CN(Cc2ccc(F)cc2)[C@@H](C)CN1C(=O)c1cc2c(C(=O)C(=O)N(C)C)cn(C)c2cc1Cl] |
|  | 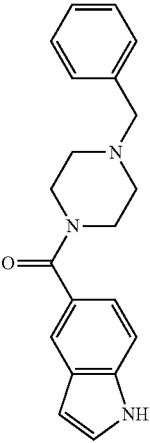 [SMILES: O=C(c1ccc2[nH]ccc2c1)N1CCN(Cc2ccccc2)CC1] |

TABLE 1-continued
Inhibitors of Mapk14 activity
| name | Chemical name or structure |
|---|---|
| | 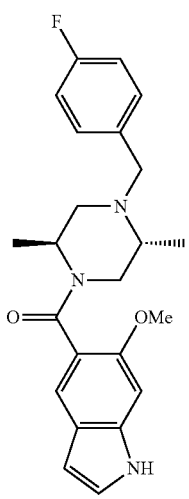 [SMILES: COc1cc2[nH]ccc2cc1C(=O)N1C[C@@H](C)N(Cc2ccc(F)cc2)C[C@@H]1C] |
| SCIO 469 (talmapimod) | 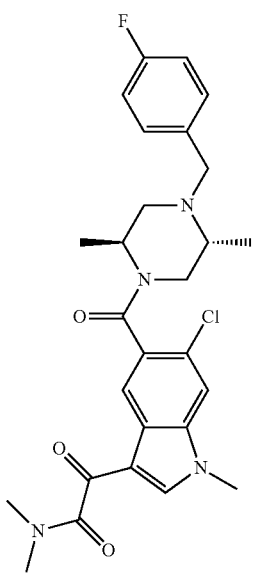<br>IC50 p38α = 9 nM<br><br>1H-indole-3-acetamide,6-chloro-5-[[(2R,5S)-4-[(4-fluorophenyl)methyl]-2,5-dimethyl-1-piperazinyl]carbonyl]-N,N,1-trimethyl-α-oxo-2-[6-chloro-5-[[(2R,5S)-4-(4-fluorobenzyl)-2,5-dimethylpiperazin-1-yl]carbonyl]-1-methyl-1H-indol-3-yl]-N,N-dimethyl-2-oxoacetamide |

TABLE 1-continued

Inhibitors of Mapk14 activity

| name | Chemical name or structure |
| --- | --- |

| | |
|---|---|
| name | Chemical name or structure |
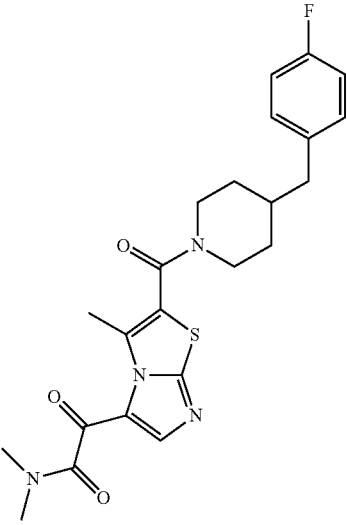 [SMILES: Cc1c(C(=O)N2CCC(Cc3ccc(F)cc3)CC2)sc2ncc(C(=O)C(=O)N(C)C)n12]
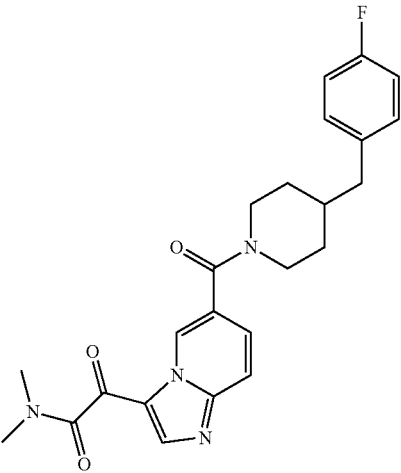 [SMILES: CN(C)C(=O)C(=O)c1cnc2ccc(C(=O)N3CCC(Cc4ccc(F)cc4)CC3)cn12]
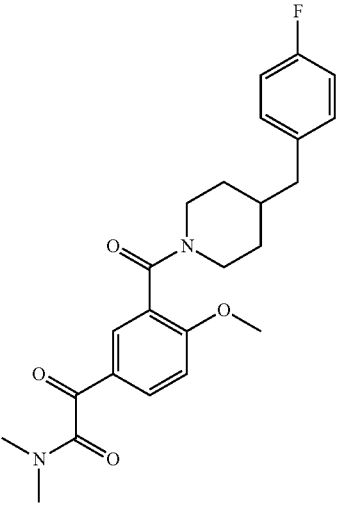 [SMILES: COc1ccc(C(=O)C(=O)N(C)C)cc1C(=O)N1CCC(Cc2ccc(F)cc2)CC1]

TABLE 1-continued
Inhibitors of Mapk14 activity
| name | Chemical name or structure |
|---|---|
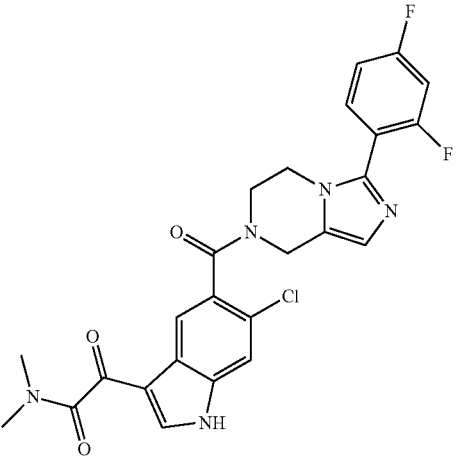
IC50 = 11 nM
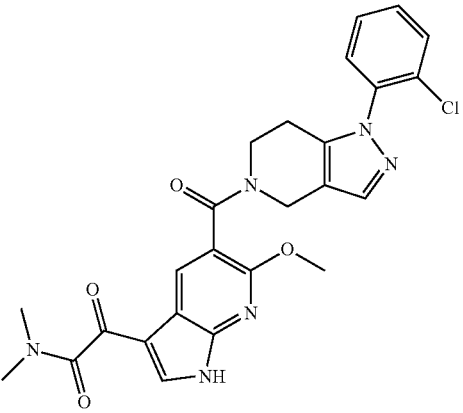
IC50 = 29 nM
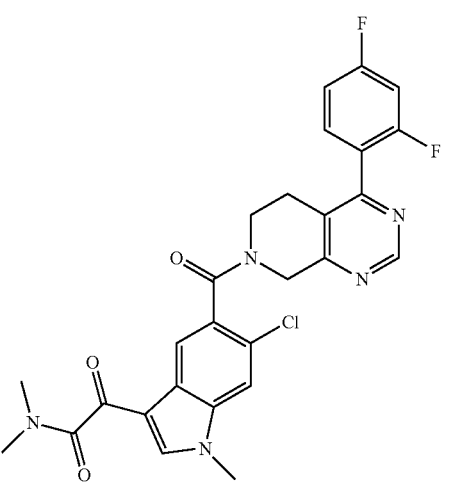 [SMILES: CN(C)C(=O)C(=O)c1cn(C)c2cc(Cl)c(C(=O)N3CCc4c(ncnc4-c4ccc(F)cc4F)C3)cc12]
SCIO 323
SCIO 469 hydrochloride  6-chloro-5-[[(2R,5S)-4-[(4-fluorophenyl)methyl]-2,5-dimethyl-1-piperazinyl]carbonyl]-N,N,1-trimethyl-α-oxo-1H-Indole-3-acetamide hydrochloride, IC50 = 9 nM TABLE 1-continued
Inhibitors of Mapk14 activity
| name | Chemical name or structure |
| --- | --- |
| SKF 86002 dihydrochloride | 6-(4-fluorophenyl)-2,3-dihydro-5-(4-pyridinyl)imidazo[2,1-b]thiazole dihydrochloride, IC50 = 0.1-1 µM |
| VX 702 | 6-[(aminocarbonyl)(2,6-difluorophenyl)amino]-2-(2,4-difluorophenyl)-3-pyridinecarboxamide, IC50 = 31 nM |
| VX 745 | 5-(2,6-dichlorophenyl)-2-[2,4-difluorophenyl)thio]-6H-pyrimido[1,6-b]pyridazin-6-one, IC50 = 5 nM |
| VX 850 | IC50 = 0.1 µM |
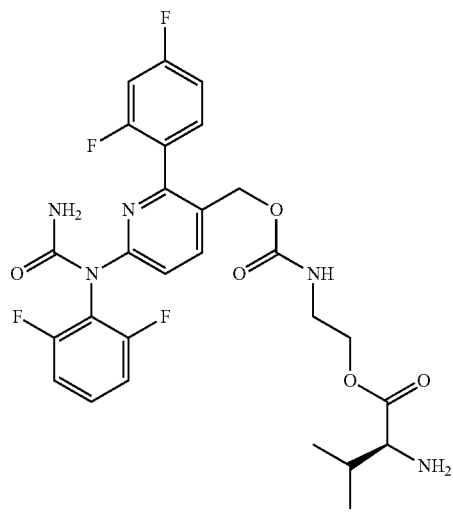
IC50 = 31 nM
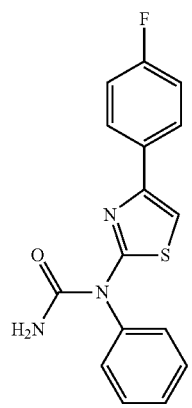 [SMILES: NC(=O)N(c1ccccc1)c1nc(-c2ccc(F)cc2)cs1]
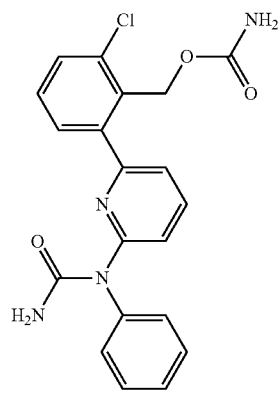 [SMILES: NC(=O)OCc1c(Cl)cccc1-c1cccc(N(C(N)=O)c2ccccc2)n1]

TABLE 1-continued
Inhibitors of Mapk14 activity
| name | Chemical name or structure |
| --- | --- |
| PH-797804 | 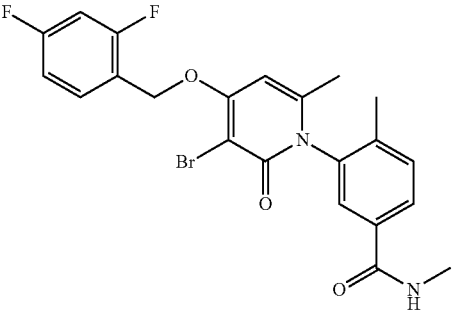<br>IC50 = 2.3 nM |
| SX 011 | 6-Chloro-5-[[4-[(4-fluorophenyl)methyl]-1-piperidinyl]carbonyl-N,N,1-trimethyl-α-oxo-1H-indole-3-acetamide, IC50 = 9 nM |
| BIRB 796 | 1-[5-tert-butyl-2-(4-methylphenyl)pyrazol-3-yl]-3-[4-(2-morpholin-4-ylethoxy)naphthalen-1-yl]urea, IC50 = 23 nM |
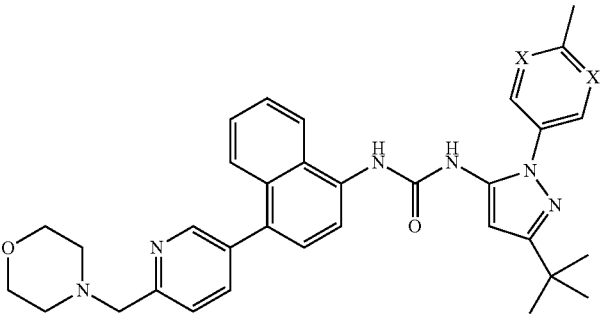
X = CH
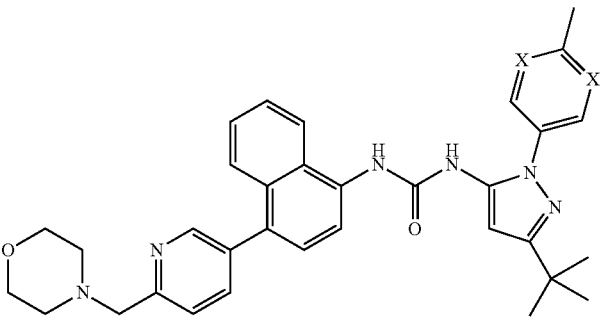
X = N
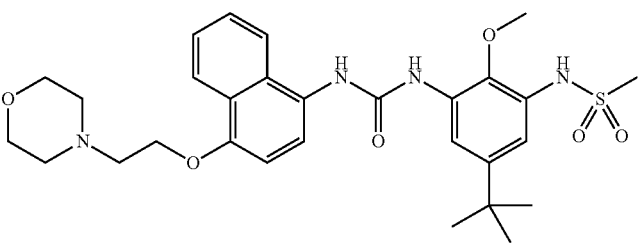 [SMILES: COc1c(NC(=O)Nc2ccc(OCCN3CCOCC3)c3ccccc23)cc(C(C)(C)C)cc1NS(C)(=O)=O]

TABLE 1-continued
Inhibitors of Mapk14 activity
| name | Chemical name or structure |
|---|---|
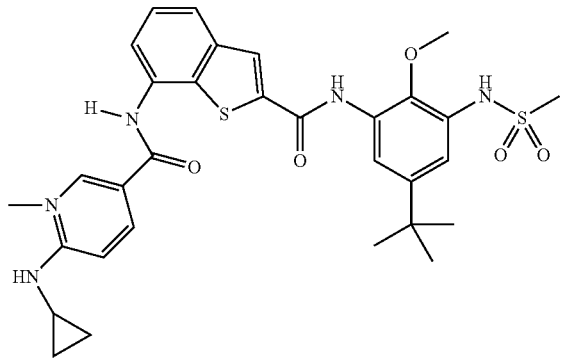
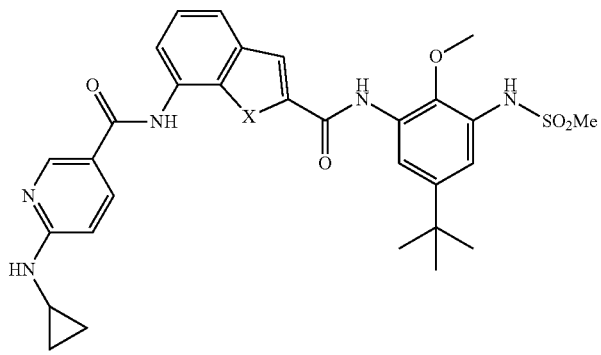
73 (X = NMe)
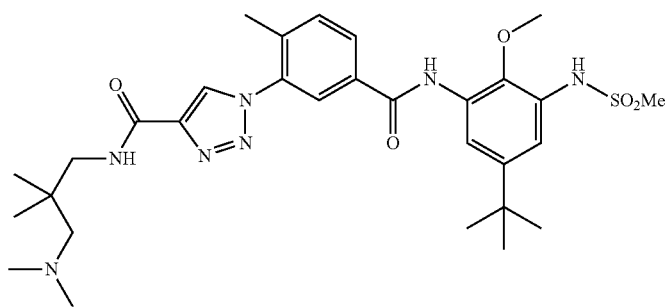 [SMILES: COc1c(NC(=O)c2ccc(C)c(-n3cc(C(=O)NCC(C)(C)CN(C)C)nn3)c2)cc(C(C)(C)C)cc1NS(C)(=O)=O]
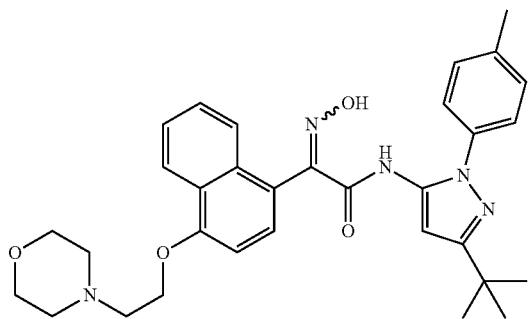 [SMILES: Cc1ccc(-n2nc(C(C)(C)C)cc2NC(=O)C(=NO)c2ccc(OCCN3CCOCC3)c3ccccc23)cc1]

TABLE 1-continued
Inhibitors of Mapk14 activity
| name | Chemical name or structure |
|---|---|
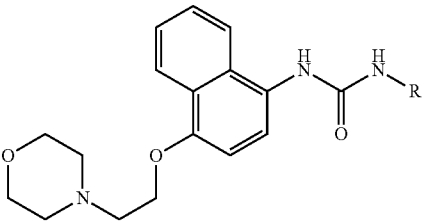
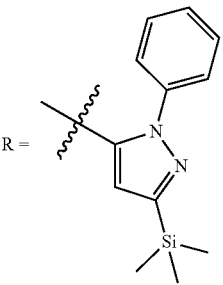 [SMILES: *c1cc([Si](C)(C)C)nn1-c1ccccc1]
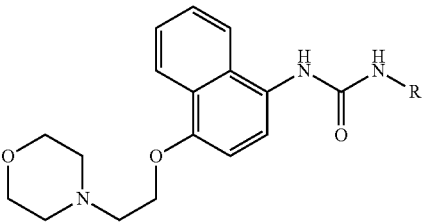
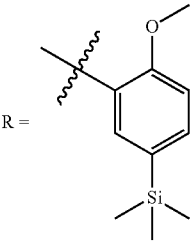 [SMILES: *c1cc([Si](C)(C)C)ccc1OC]
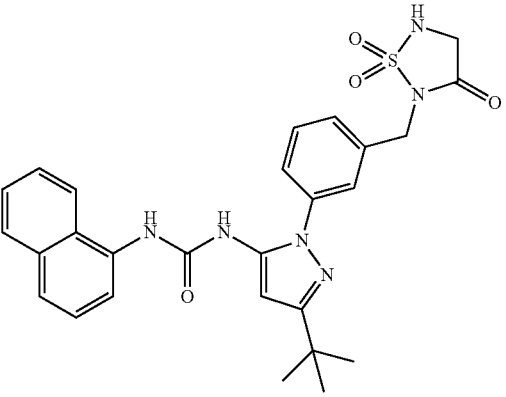
IC50 = 19 nM TABLE 1-continued
Inhibitors of Mapk14 activity
| name | Chemical name or structure |
|---|---|
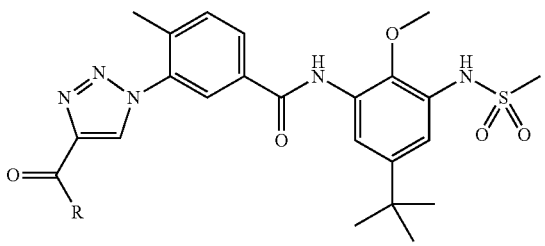
R = 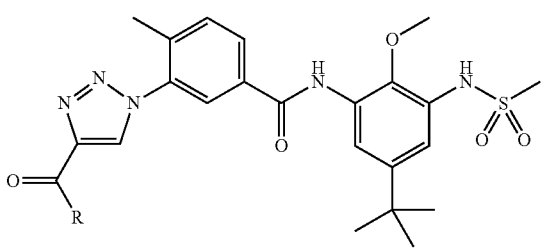
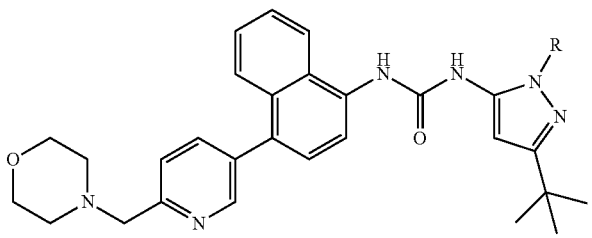
(R = 4-tolyl)
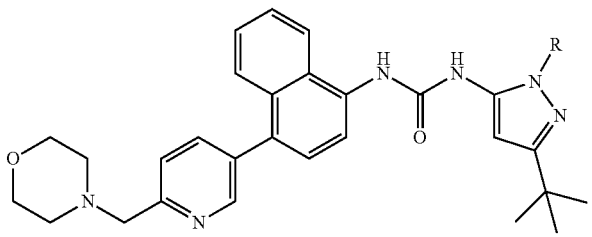
(R = 2-methylpyrimidin-5-yl)
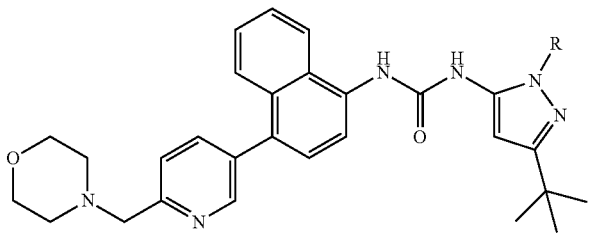
(R = 1-methyl-1H-pyrazol-4-yl)

TABLE 1-continued

Inhibitors of Mapk14 activity

| name | Chemical name or structure |
|---|---|

IC50 = 6 nM

TABLE 1-continued

Inhibitors of Mapk14 activity

| name | Chemical name or structure |
|------|---------------------------|

IC50 = 3.1 nM

IC50 = 0.98 nM (X = N)

X = CH

татв
TABLE 1-continued
Inhibitors of Mapk14 activity
| name | Chemical name or structure |
|---|---|
| | 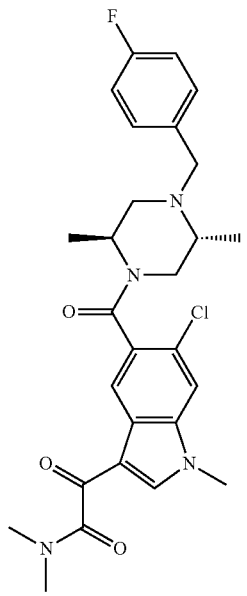 |
| | 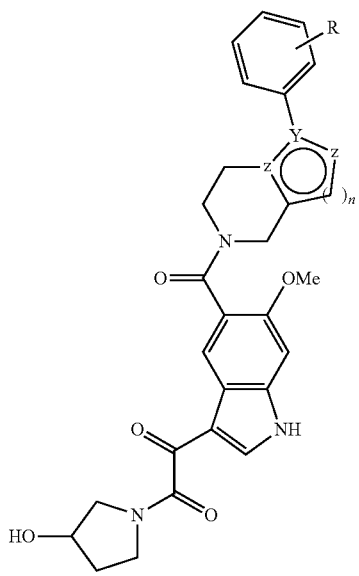 |

TABLE 1-continued
Inhibitors of Mapk14 activity
| name | Chemical name or structure |
|------|----------------------------|
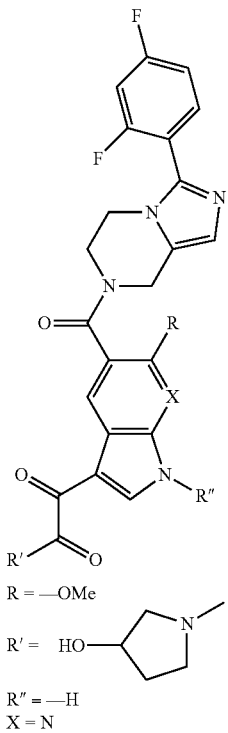
R = —OMe
R' = HO-[3-(1-methylpyrrolidinyl)]
R'' = —H
X = N
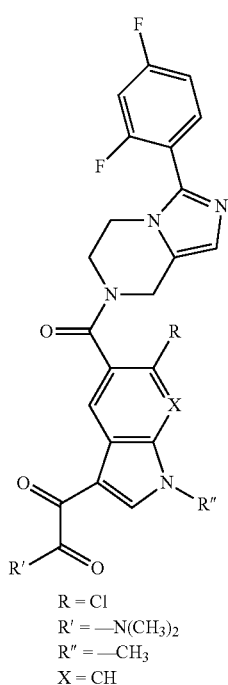
R = Cl
R' = —N(CH$_3$)$_2$
R'' = —CH$_3$
X = CH TABLE 1-continued
Inhibitors of Mapk14 activity
| name | Chemical name or structure |
| --- | --- |
|  | 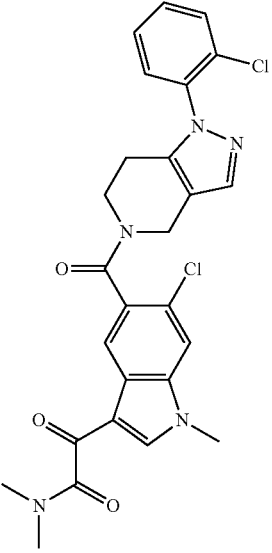 [SMILES: CN(C)C(=O)C(=O)c1cn(C)c2cc(Cl)c(C(=O)N3CCc4c(cnn4-c4ccccc4Cl)C3)cc12] |
|  | 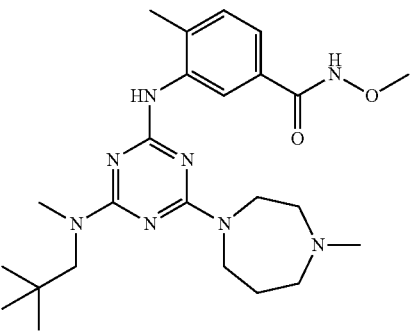<br>IC50 = 44 nM |
|  | 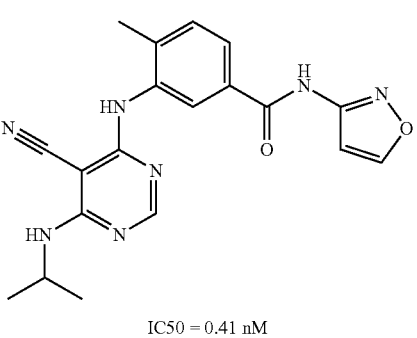 [SMILES: Cc1ccc(C(=O)Nc2ccon2)cc1Nc1ncnc(NC(C)C)c1C#N]<br>IC50 = 0.41 nM |
|  | 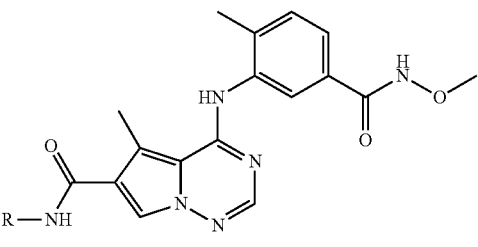<br>R = Et<br>IC50 = 3.1 nM |

TABLE 1-continued
Inhibitors of Mapk14 activity
| name | Chemical name or structure |
| --- | --- |
| | 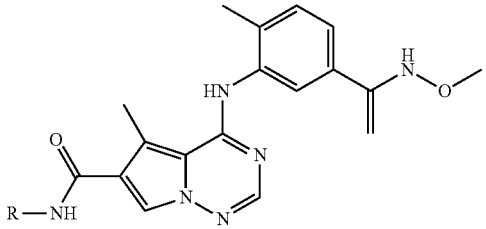
R = (S)-α-Me-benzyl
IC50 = 2.2 nM |
| | 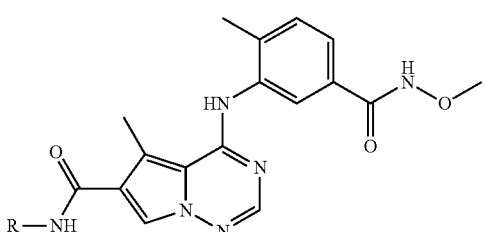
R = (S)-α-Me-benzyl
IC50 = 0.46 nM |
| | 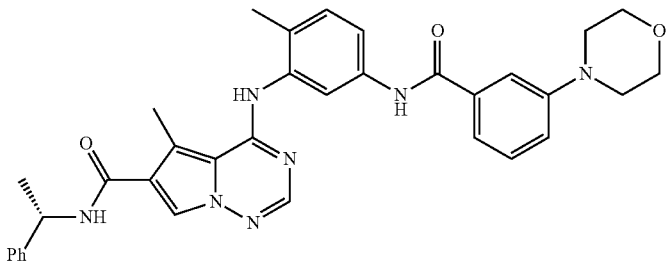 [SMILES: Cc1ccc(NC(=O)c2cccc(N3CCOCC3)c2)cc1Nc1ncnn2cc(C(=O)N[C@@H](C)c3ccccc3)c(C)c12] |
| BMS-640994 | 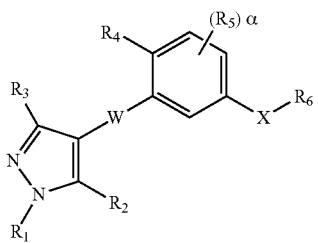
IC50 = 3.5 nM |

TABLE 1-continued

Inhibitors of Mapk14 activity

| name | Chemical name or structure |
|------|----------------------------|

TABLE 1-continued
Inhibitors of Mapk14 activity
| name | Chemical name or structure |
|------|----------------------------|
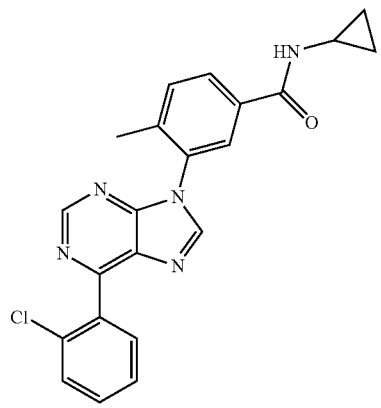 [SMILES: Cc1ccc(C(=O)NC2CC2)cc1-n1cnc2c(-c3ccccc3Cl)ncnc21]
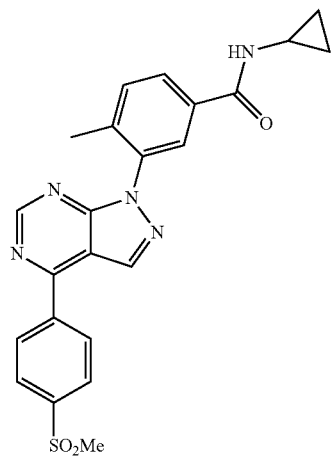 [SMILES: Cc1ccc(C(=O)NC2CC2)cc1-n1ncc2c(-c3ccc(S(C)(=O)=O)cc3)ncnc21]
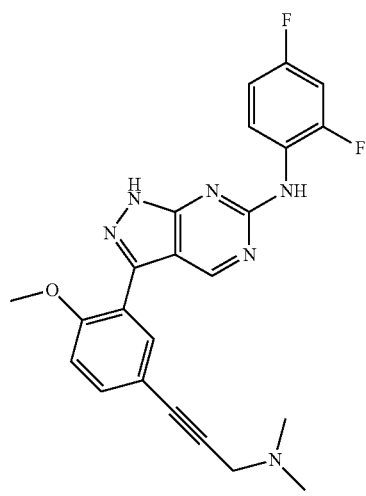
IC50 = 0.6 nM TABLE 1-continued
Inhibitors of Mapk14 activity
| name | Chemical name or structure |
| --- | --- |
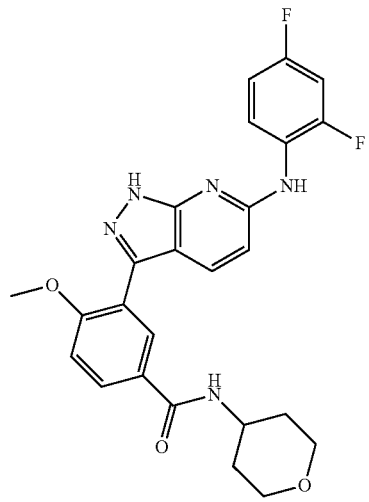
IC50 = 0.7 nM
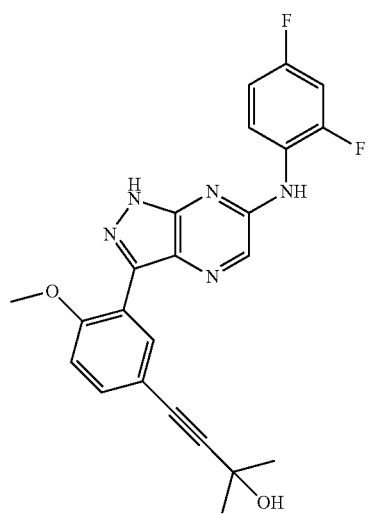
IC50 = 7 nM TABLE 1-continued Inhibitors of Mapk14 activity

| name | Chemical name or structure |
|---|---|

[Structure: 4-(2,4-difluorophenyl)-substituted tetrahydropyrido-pyrimidine linked via amide to chloro-N-methylindole bearing an α-ketoamide with N,N-dimethyl group]

[Structure: benzophenone with R₁ on one ring, R₂ on the other, linked via NH to a phenyl bearing R₃]

[Structure: dibenzo fused tricyclic ketone with X—Y bridge, NH-phenyl-R₂ substituent]

[Structure: fused tricyclic scaffold]

X, Y = CH, CH$_2$, O, S
A = CH$_2$, N, O
z = N, CH
IC50 = 6 nM

| | |
|---|---|
| BI 78D3 | 4-(2,3-Dihydro-1,4-benzodioxin-6-yl)-2,4-dihydro-5-[(5-nitro-2-thiazolyl)thio]-3H-1,2,4-triazol-3-one |
| CGH 2466 dihydrochloride | 4-(3,4-Dichlorophenyl)-5-(4-pyridinyl)-2-thiazolamine dihydrochloride |
| PD 169316 | 4-[5-(4-fluorophenyl)-2-(4-nitrophenyl)-1H-imidazol-4-yl]-pyridine, IC50 = 15 nM |

TABLE 1-continued
Inhibitors of Mapk14 activity
| name | Chemical name or structure |
|---|---|
| RO 3201195 | 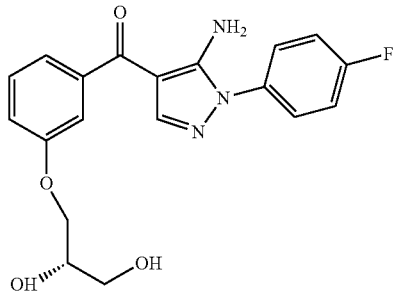 [SMILES: Nc1c(C(=O)c2cccc(OC[C@@H](O)CO)c2)cnn1-c1ccc(F)cc1] |
| RO4402257 | |
| AMG 548 | 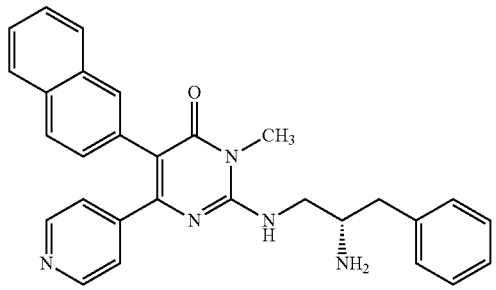 [SMILES: Cn1c(NC[C@@H](N)Cc2ccccc2)nc(-c2ccncc2)c(-c2ccc3ccccc3c2)c1=O] |
| GSK 681323 | |
| AVE 9940 | |
| PS 540446 | |
| PS 516895 | |
| SC 80036 | 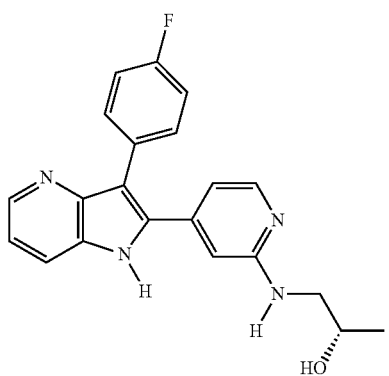 [SMILES: C[C@H](O)CNc1cc(-c2[nH]c3cccnc3c2-c2ccc(F)cc2)ccn1] |

TABLE 1-continued
Inhibitors of Mapk14 activity
| name | Chemical name or structure |
| --- | --- |
| PH 797804 | 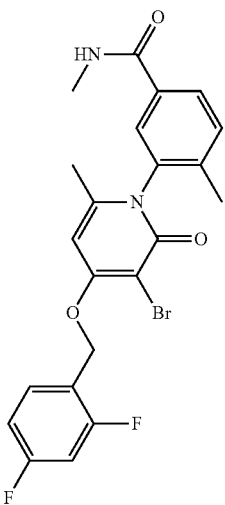 [SMILES: CNC(=O)c1ccc(C)c(-n2c(C)cc(OCc3ccc(F)cc3F)c(Br)c2=O)c1] |
| | 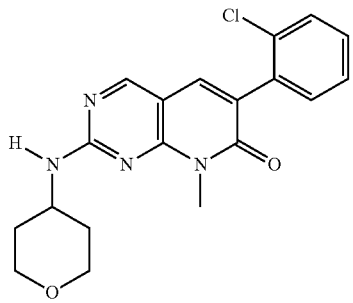 [SMILES: Cn1c(=O)c(-c2ccccc2Cl)cc2cnc(NC3CCOCC3)nc21] |
| TAK 715 | N-(4-(2-Ethyl-4-(3-methylphenyl)-thiazol-5-yl)31yridine-2-yl)benzamide, IC50 = 7.1 nM |
| R1487 | 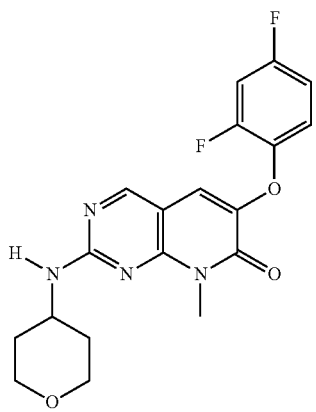<br>IC50 = 10 nM |

TABLE 1-continued
Inhibitors of Mapk14 activity
| name | Chemical name or structure |
|------|---------------------------|
|  | 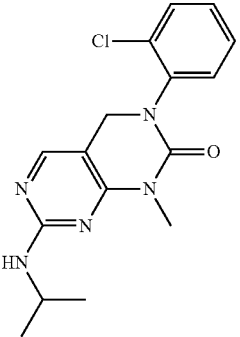 [SMILES: CC(C)Nc1ncc2c(n1)N(C)C(=O)N(c1ccccc1Cl)C2] |
|  | 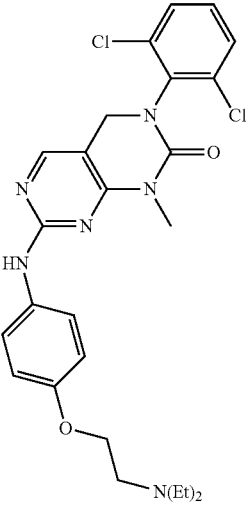 |
| Pamapimod | 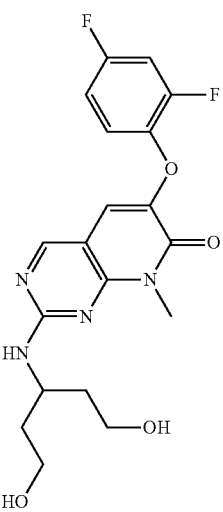<br>IC50 = 14 nM, |

TABLE 1-continued
Inhibitors of Mapk14 activity
| name | Chemical name or structure |
|---|---|
| | 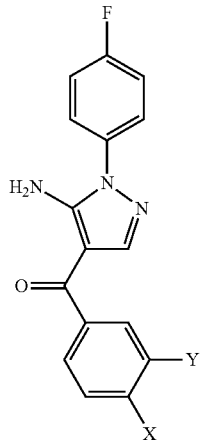 |
| | 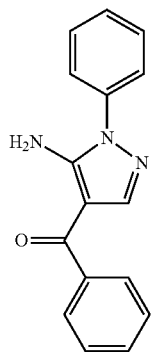 |
| | 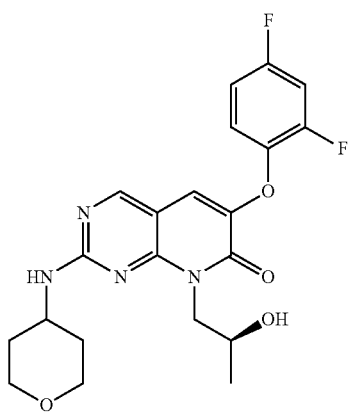 [SMILES: C[C@H](O)Cn1c(=O)c(Oc2ccc(F)cc2F)cc2cnc(NC3CCOCC3)nc21] |

US 10,441,577 B2
61
62
TABLE 1-continued
Inhibitors of Mapk14 activity
| name | Chemical name or structure |
|---|---|
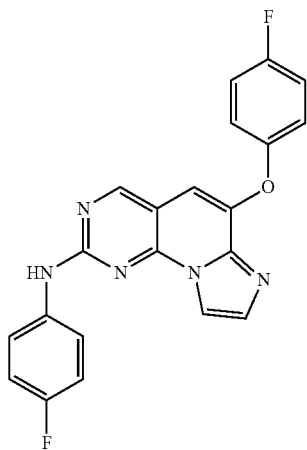 [SMILES: Fc1ccc(Nc2ncc3cc(Oc4ccc(F)cc4)c4nccn4c3n2)cc1]
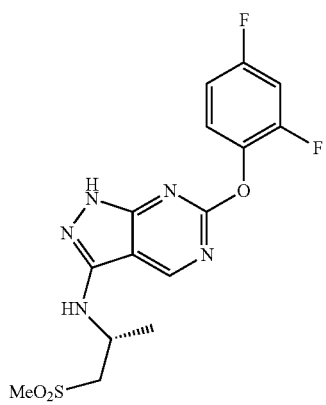 [SMILES: C[C@H](CS(C)(=O)=O)Nc1n[nH]c2nc(Oc3ccc(F)cc3F)ncc12]
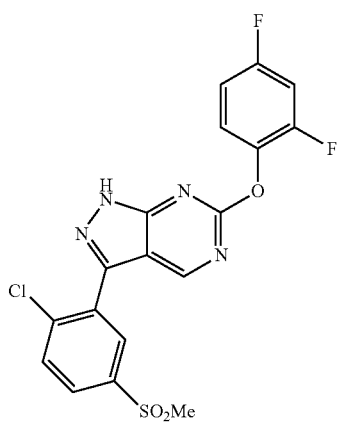 [SMILES: CS(=O)(=O)c1ccc(Cl)c(-c2n[nH]c3nc(Oc4ccc(F)cc4F)ncc23)c1]

TABLE 1-continued
Inhibitors of Mapk14 activity
| name | Chemical name or structure |
|---|---|
|  | 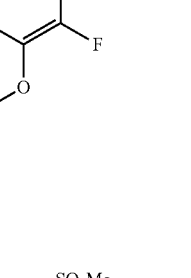 |
| SD-06 | 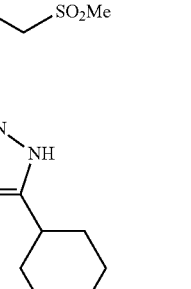 |
|  | 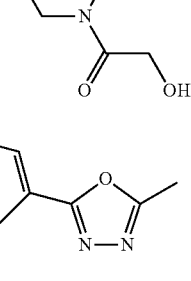 |
|  |  |

TABLE 1-continued
Inhibitors of Mapk14 activity
| name | Chemical name or structure |
|---|---|
| | 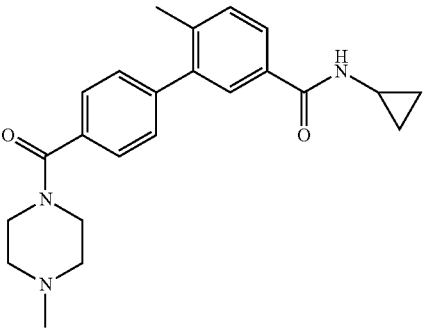 [SMILES: Cc1ccc(C(=O)NC2CC2)cc1-c1ccc(C(=O)N2CCN(C)CC2)cc1] |
| | 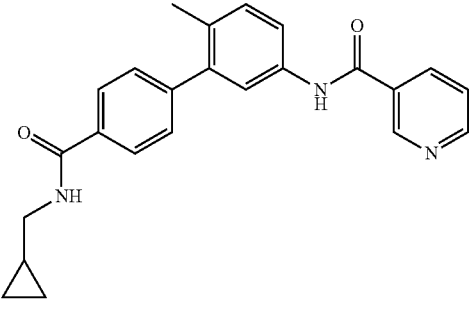 [SMILES: Cc1ccc(NC(=O)c2cccnc2)cc1-c1ccc(C(=O)NCC2CC2)cc1] |
| | 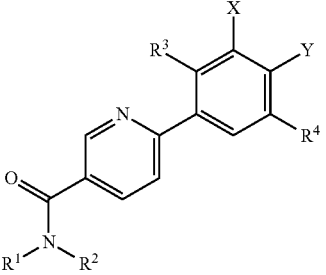 |
| | 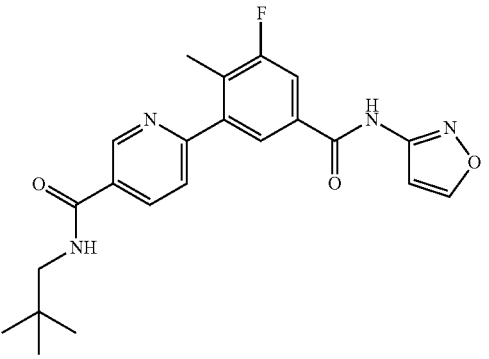 [SMILES: Cc1c(F)cc(C(=O)Nc2ccon2)cc1-c1ccc(C(=O)NCC(C)(C)C)cn1] |
| | 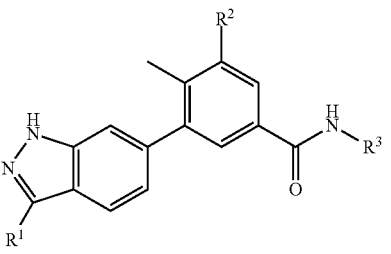 |

TABLE 1-continued

Inhibitors of Mapk14 activity

| name | Chemical name or structure |
|------|---------------------------|
| | (structures only) |

TABLE 1-continued
Inhibitors of Mapk14 activity
| name | Chemical name or structure |
|---|---|
| | 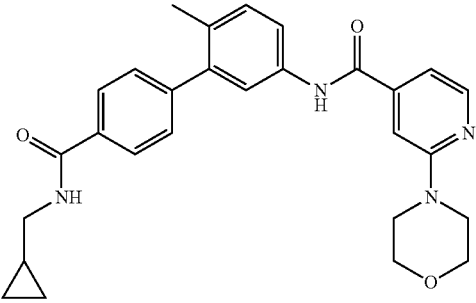 [SMILES: Cc1ccc(NC(=O)c2ccnc(N3CCOCC3)c2)cc1-c1ccc(C(=O)NCC2CC2)cc1] |
| BMS (WO04043912) | 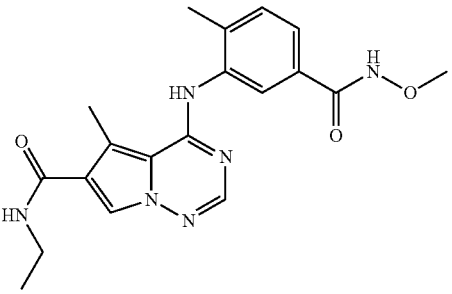 [SMILES: CCNC(=O)c1cn2ncnc(Nc3cc(C(=O)NOC)ccc3C)c2c1C] |
| | 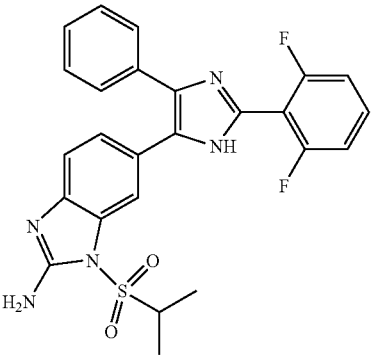 [SMILES: CC(C)S(=O)(=O)n1c(N)nc2ccc(-c3[nH]c(-c4c(F)cccc4F)nc3-c3ccccc3)cc21] |
| | 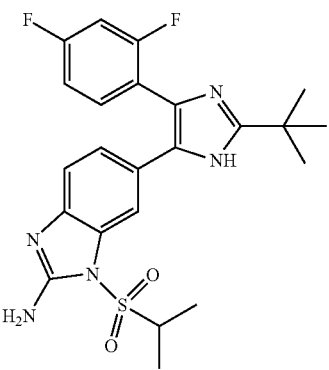
IC50 = 4.4 nM |

TABLE 1-continued
Inhibitors of Mapk14 activity
| name | Chemical name or structure |
|---|---|
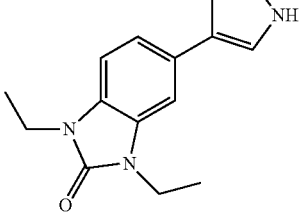
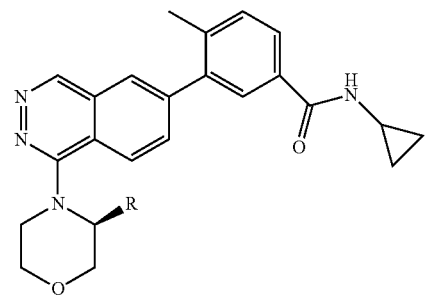
R = CH₃
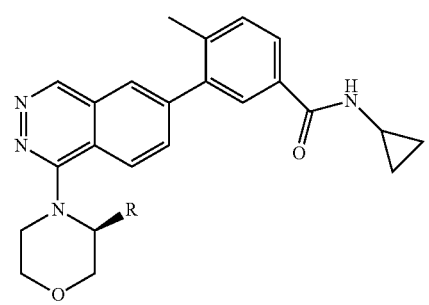
R = H
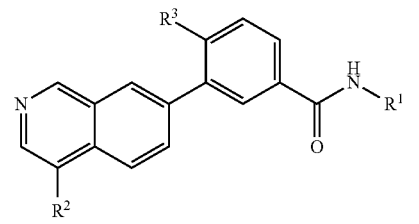
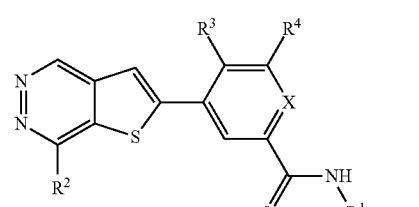

TABLE 1-continued

Inhibitors of Mapk14 activity

| name | Chemical name or structure |
|---|---|

IC50 = 2.4 nM

TABLE 1-continued
Inhibitors of Mapk14 activity
| name | Chemical name or structure |
| --- | --- |
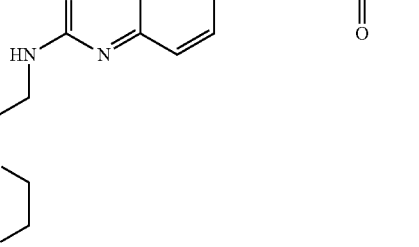
R¹ = m-CF₃Ph
IC50 = 2.7 nM
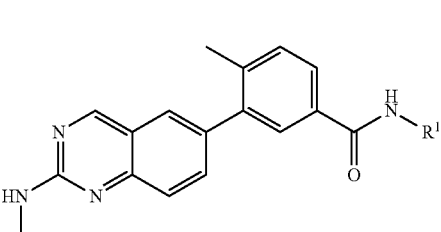
R1 = cyclopropyl
IC50 = 2 nM
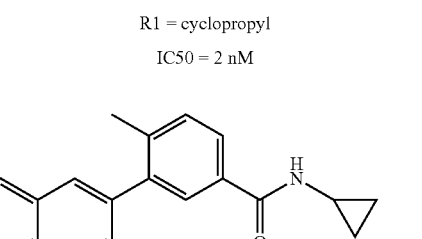
R² = I-morpholino
IC50 = 1.2 nM
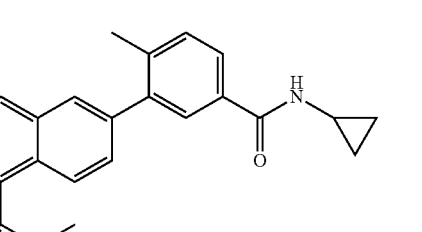
IC50 = 0.8 nM TABLE 1-continued
Inhibitors of Mapk14 activity
| name | Chemical name or structure |
|------|---------------------------|
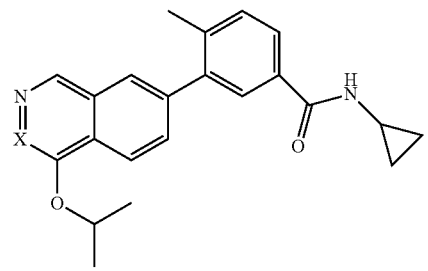
X = N
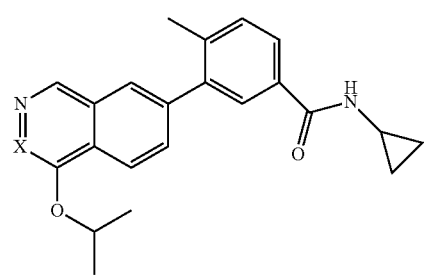
X = CH
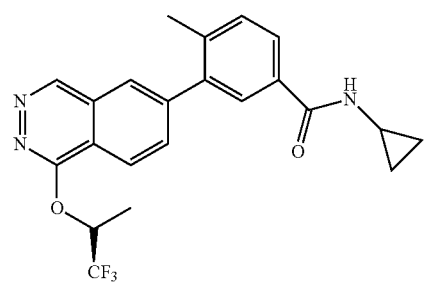
IC50 = 1 nM
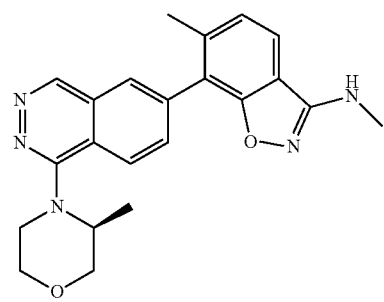 [SMILES: CNc1noc2c(-c3ccc4c(N5CCOC[C@@H]5C)nncc4c3)c(C)ccc12]
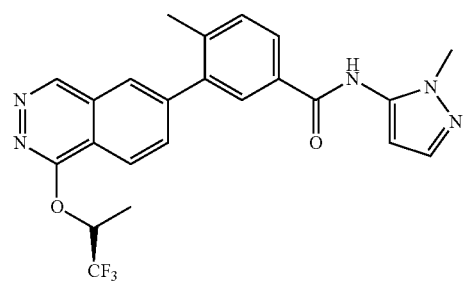 [SMILES: Cc1ccc(C(=O)Nc2ccnn2C)cc1-c1ccc2c(O[C@@H](C)C(F)(F)F)nncc2c1]

TABLE 1-continued
Inhibitors of Mapk14 activity
| name | Chemical name or structure |
|------|----------------------------|
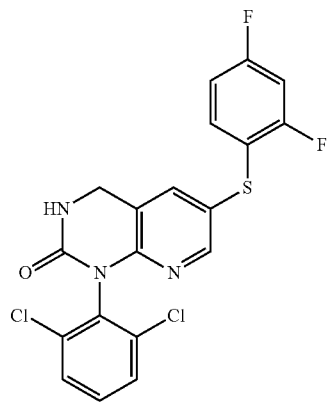
IC50 = 25 nM
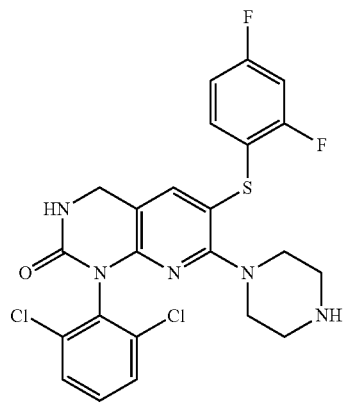
IC50 = 0.2 nM
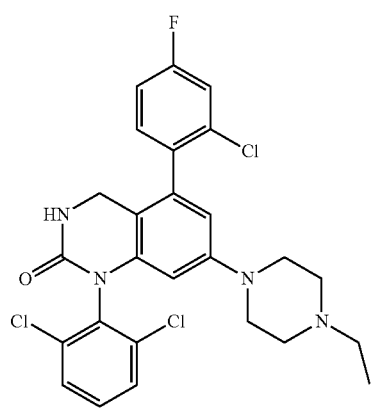
IC50 = 0.5 nM TABLE 1-continued
Inhibitors of Mapk14 activity
| name | Chemical name or structure |
|------|----------------------------|
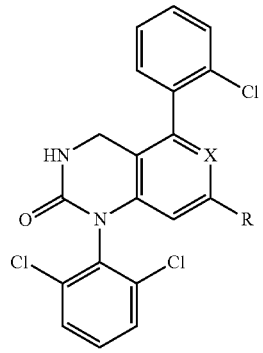
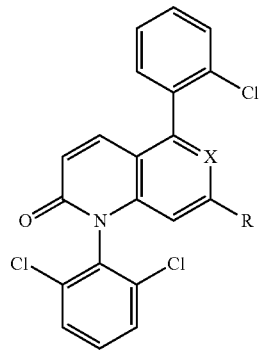
(X = CH, N)
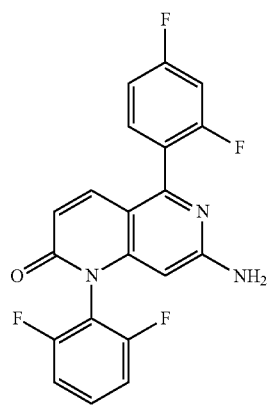
IC50 = 0.69 nM TABLE 1-continued
Inhibitors of Mapk14 activity
| name | Chemical name or structure |
|------|----------------------------|
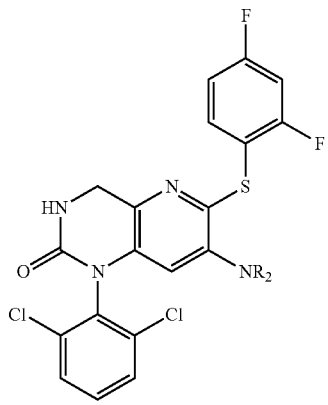
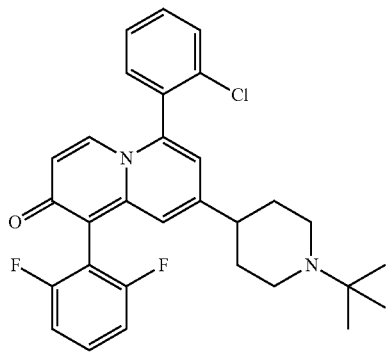 [SMILES: CC(C)(C)N1CCC(c2cc(-c3ccccc3Cl)n3ccc(=O)c(-c4c(F)cccc4F)c3c2)CC1]
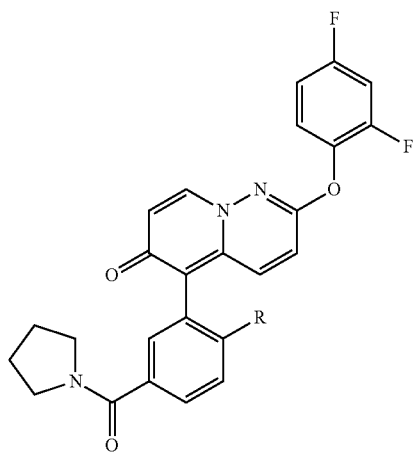
(R = OMe)

TABLE 1-continued
Inhibitors of Mapk14 activity
| name | Chemical name or structure |
|---|---|
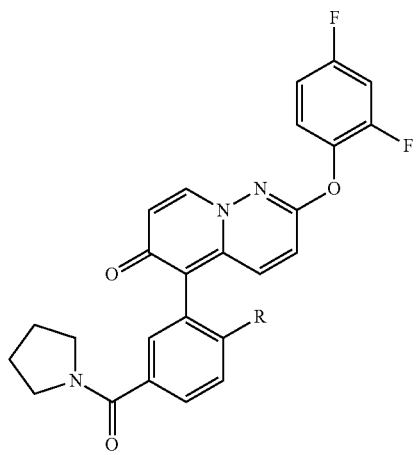
(R = Et)
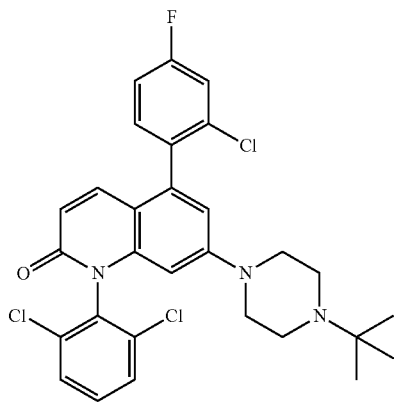 [SMILES: CC(C)(C)N1CCN(c2cc(-c3ccc(F)cc3Cl)c3ccc(=O)n(-c4c(Cl)cccc4Cl)c3c2)CC1]
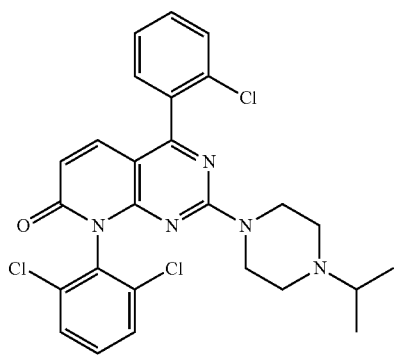 [SMILES: CC(C)N1CCN(c2nc(-c3ccccc3Cl)c3ccc(=O)n(-c4c(Cl)cccc4Cl)c3n2)CC1]

TABLE 1-continued
Inhibitors of Mapk14 activity
| name | Chemical name or structure |
|---|---|
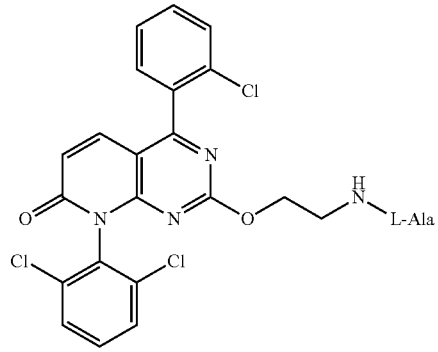
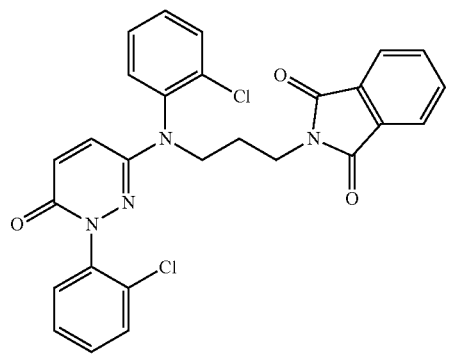
IC50 = 5 nM
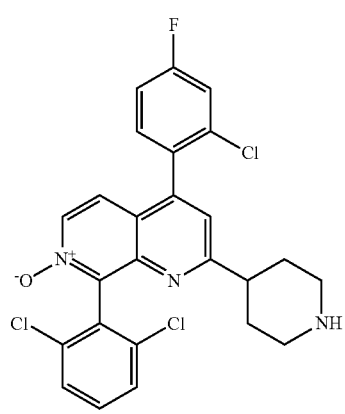

TABLE 1-continued
Inhibitors of Mapk14 activity
| name | Chemical name or structure |
|---|---|
| | 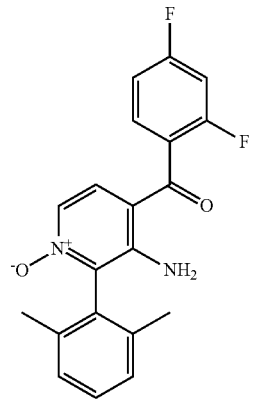
IC50 = 6 nM |
| | 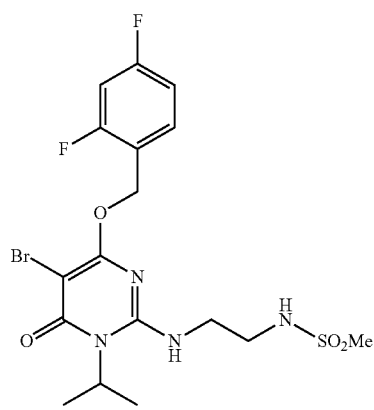
IC50 = 1.7 nM |
| | 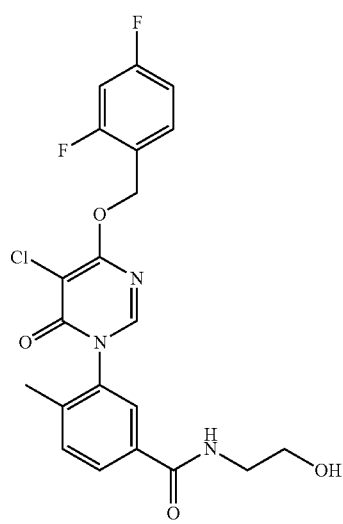 [SMILES: Cc1ccc(C(=O)NCCO)cc1-n1cnc(OCc2ccc(F)cc2F)c(Cl)c1=O] |

TABLE 1-continued
Inhibitors of Mapk14 activity
| name | Chemical name or structure |
|------|---------------------------|
|  | 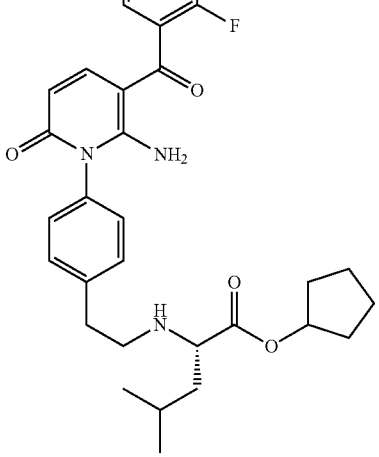<br>IC50 < 50 nM |
|  | 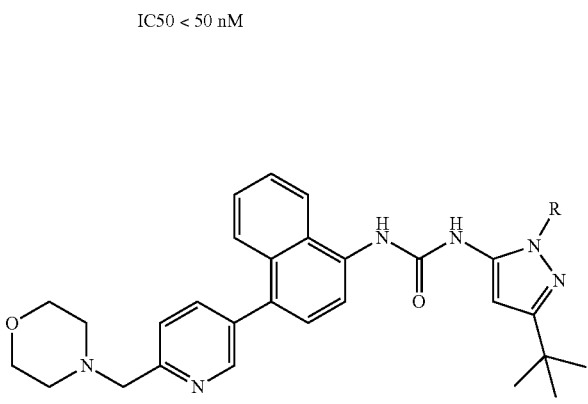<br>(R = 4-tolyl) |
|  | 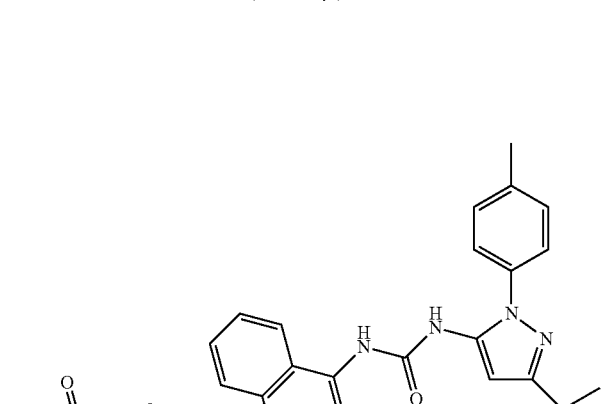<br>IC50 = 34 nM |

TABLE 1-continued
Inhibitors of Mapk14 activity
| name | Chemical name or structure |
|------|---------------------------|
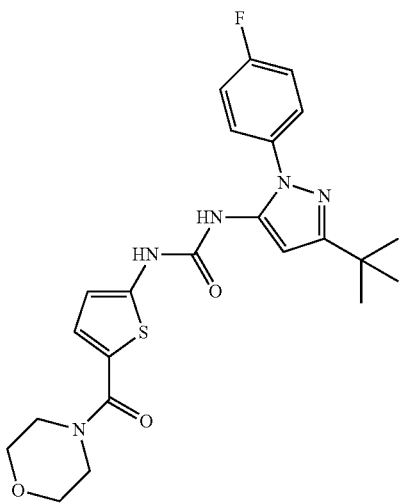 [SMILES: CC(C)(C)c1cc(NC(=O)Nc2ccc(C(=O)N3CCOCC3)s2)n(-c2ccc(F)cc2)n1]
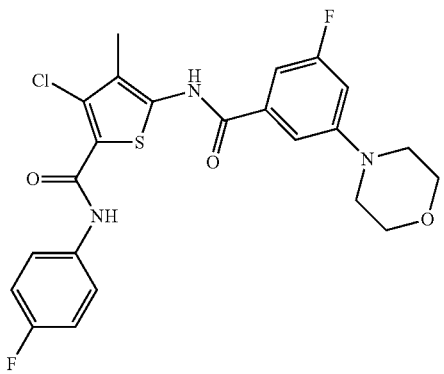 [SMILES: Cc1c(NC(=O)c2cc(F)cc(N3CCOCC3)c2)sc(C(=O)Nc2ccc(F)cc2)c1Cl]
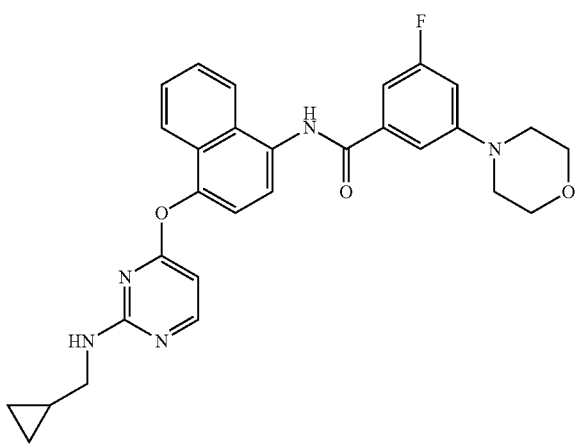
IC50 = 2.5 nM TABLE 1-continued
Inhibitors of Mapk14 activity
| name | Chemical name or structure |
|------|----------------------------|
|      | 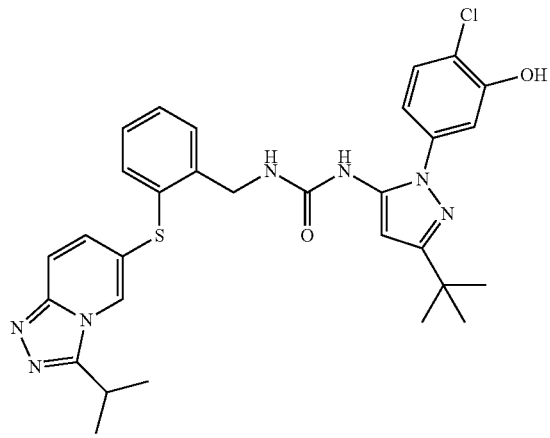 IC50 = 0.8 nM |
|      | 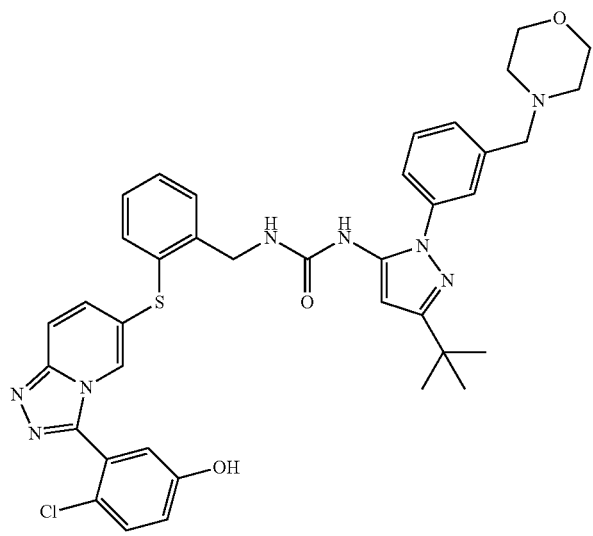 IC50 = 1.8 nM |
|      | 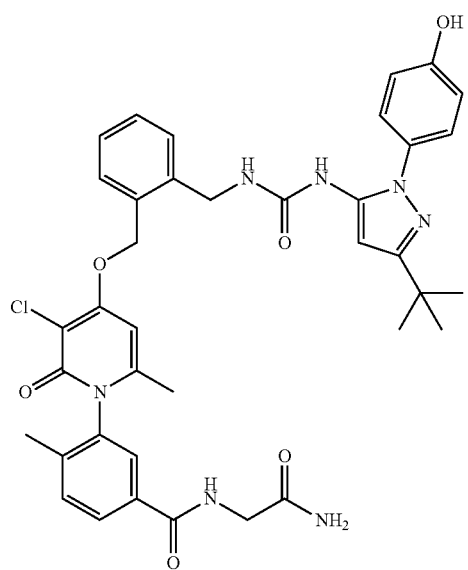 [SMILES: Cc1ccc(C(=O)NCC(N)=O)cc1-n1c(C)cc(OCc2ccccc2CNC(=O)Nc2cc(C(C)(C)C)nn2-c2ccc(O)cc2)c(Cl)c1=O] |

TABLE 1-continued
Inhibitors of Mapk14 activity
| name | Chemical name or structure |
|------|---------------------------|
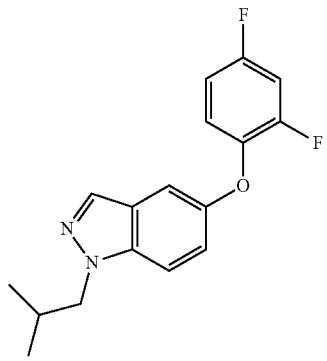
IC50 = 45 nM
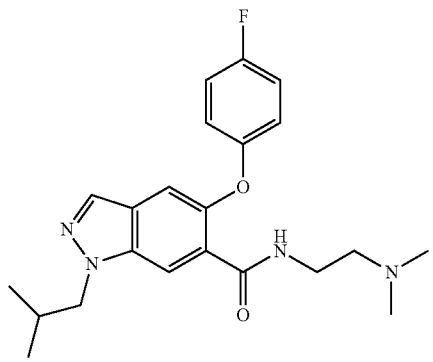
IC50 = 27 nM
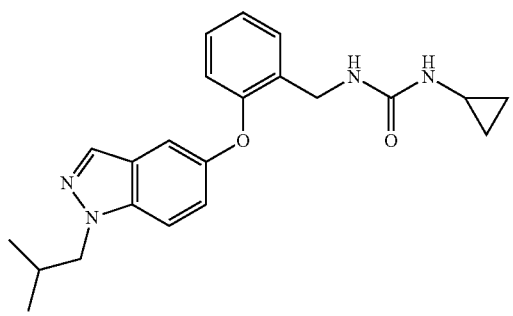
IC50 = 12 nM TABLE 1-continued
Inhibitors of Mapk14 activity
| name | Chemical name or structure |
|---|---|
| | 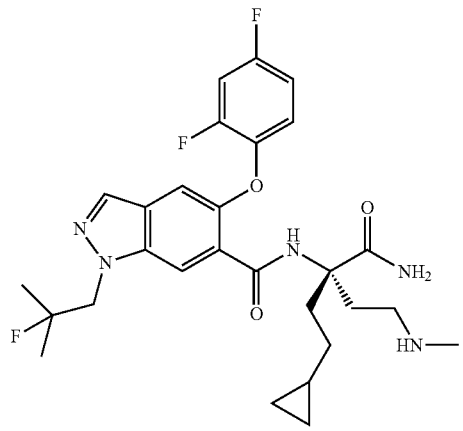<br>IC50 < 20 nM |
| RPR203494 | 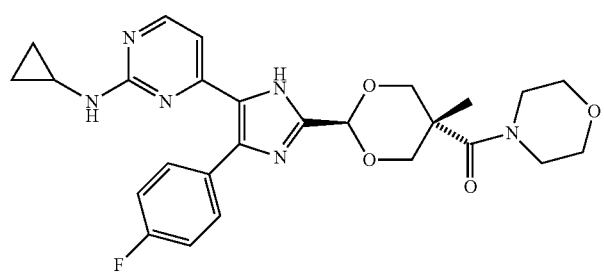 |
| | 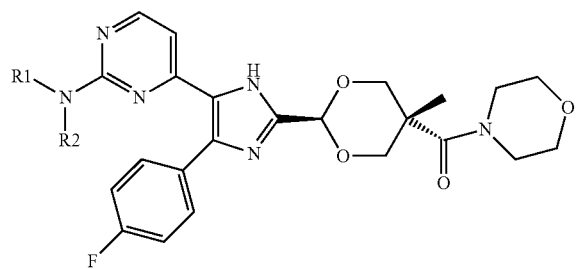 |
| R1 | R2 |
|---|---|
| Methyl | H |
| Methyl | Methyl |
| Cyclopropyl | H |
| Cyclohexyl | H |
| —CH$_2$—(CH$_2$)$_3$—CH$_2$— | |
| Carboxymethyl | H |
| Carboxyethyl | H |
| Aminoethyl | H |
| N,N-Dimethylaminoethyl | H |
| N,N-Dimethylaminopropyl | H |

TABLE 1-continued

Inhibitors of Mapk14 activity

| name | Chemical name or structure | | |
|---|---|---|---|
| | Hydroxyethyl | H | |
| | Hydroxypropyl | H | |
| | 3-Methoxypropyl | H | |
| | H | H | |
| | Allyl | H | |
| | Cyclopropylmethyl | H | |
| | Cyanoethyl | H | |
| | Propyl | H | |
| | Benzyl | H | |
| | 2-Thienyl-methyl | H | |
| | (R)-α-Methyl-benzyl | H | |
| | (S)-α-Methyl-benzyl | H | |
| | 2-Pyridyl-methyl | H | |
| | 2-Methoxybenzyl | H | |
| | 4-Fluorobenzyl | H | |
| | Phenyl | H | |
| | 3-Pyridinyl | H | |
| | 4-Pyridinyl | H | |
| | 3-Methoxyphenyl | H | |
| ARRY 797 | IC50 < 5 nM | | |
| ARRY-371797 | | | |
| ARRY-614 | | | |
| ARQ 101 | | | |
| AR00182263 | | | |
| AZD6703 | | | |
| RPR200765A | | | |
| RPR203494 | trans-N-cyclopropyl-4-[4-(4-fluorophenyl)-2-[5-methyl-5-(4-morpholinylcarbonyl)-1,3-dioxan-2-yl]-1H-imidazol-5-yl]pyrimidin-2-amine, IC50 = 9 nM | | |
| R04402257 | | | |
| 803201195 | | | |
| KC706 | | | |
| SC-80036 | | | |
| SCI-496 | | | |
| SX001 | IC50 = 9 nM | | |
| Semapimod | | | |

103 104
TABLE 1-continued
Inhibitors of Mapk14 activity
| name | Chemical name or structure |
|---|---|
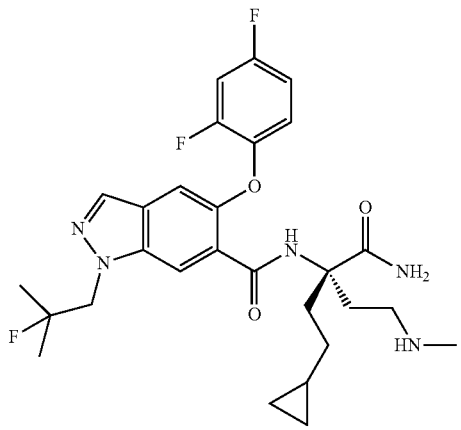
IC50 < 20 nM
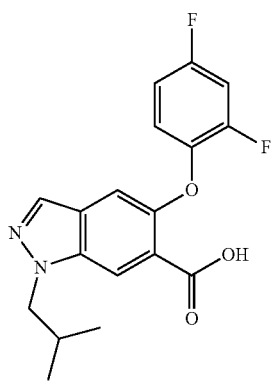
IC50 < 20 nM
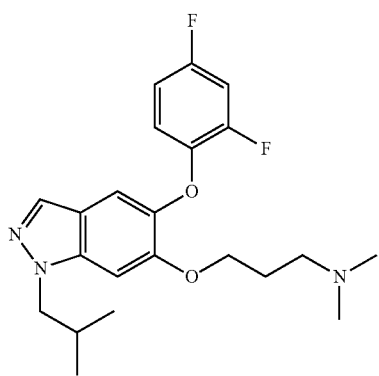
IC50 < 20 nM TABLE 1-continued
Inhibitors of Mapk14 activity
| name | Chemical name or structure |
|------|---------------------------|
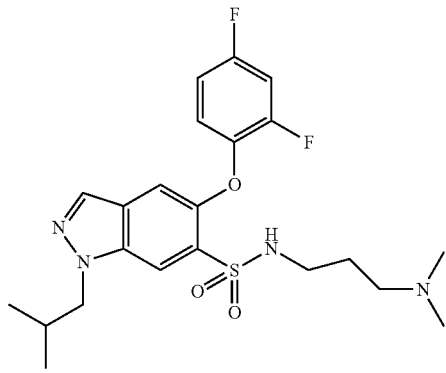
IC50 < 20 nM
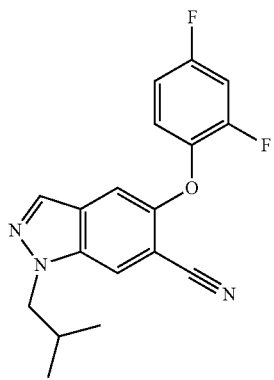 [SMILES: CC(C)Cn1ncc2cc(Oc3ccc(F)cc3F)c(C#N)cc21]
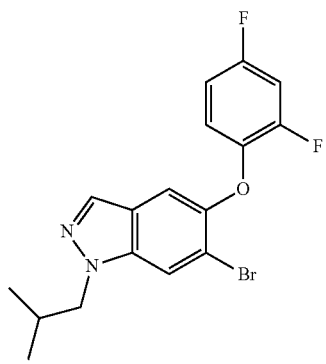 [SMILES: CC(C)Cn1ncc2cc(Oc3ccc(F)cc3F)c(Br)cc21]
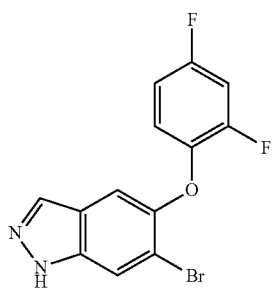 [SMILES: Fc1ccc(Oc2cc3cn[nH]c3cc2Br)c(F)c1]

TABLE 1-continued
Inhibitors of Mapk14 activity
| name | Chemical name or structure |
|---|---|
| | 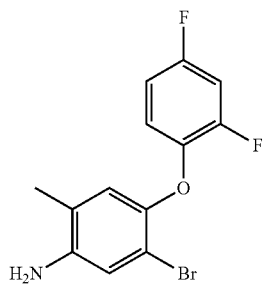 |
| | 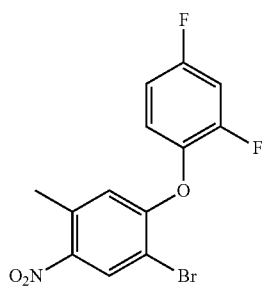 [SMILES: Cc1cc(Oc2ccc(F)cc2F)c(Br)cc1[N+](=O)[O-]] |
| | 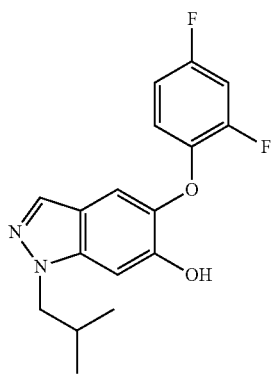 [SMILES: CC(C)Cn1ncc2cc(Oc3ccc(F)cc3F)c(O)cc21] |
| | 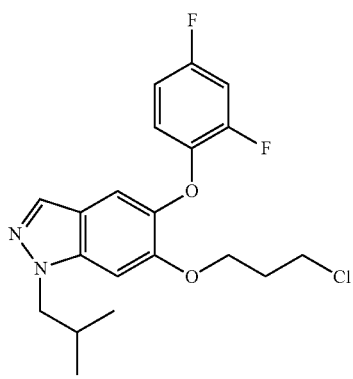 [SMILES: CC(C)Cn1ncc2cc(Oc3ccc(F)cc3F)c(OCCCCl)cc21] |

TABLE 1-continued
Inhibitors of Mapk14 activity
| name | Chemical name or structure |
|------|----------------------------|
|      | 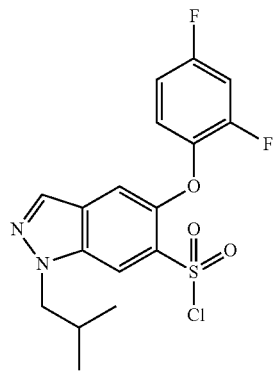 [SMILES: CC(C)Cn1ncc2cc(Oc3ccc(F)cc3F)c(S(=O)(=O)Cl)cc21]       |
|      | 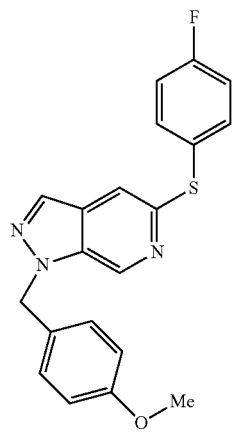 [SMILES: COc1ccc(Cn2ncc3cc(Sc4ccc(F)cc4)ncc32)cc1]       |
|      | 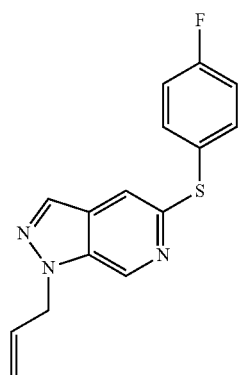 [SMILES: C=CCn1ncc2cc(Sc3ccc(F)cc3)ncc21]       |
|      | 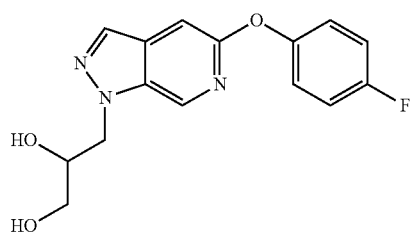 [SMILES: OCC(O)Cn1ncc2cc(Oc3ccc(F)cc3)ncc21]       |

TABLE 1-continued

Inhibitors of Mapk14 activity

| name | Chemical name or structure |
|---|---|
| | |
| 7b | 7b1: R = CH$_2$CH=CH$_2$<br>7b2: R = CH$_2$CH$_2$CH$_2$NMe$_2$<br>7b3: R = CH$_2$CH$_2$CH$_2$NHBoc |
| | |

TABLE 1-continued
Inhibitors of Mapk14 activity
| name | Chemical name or structure |
|---|---|
| | 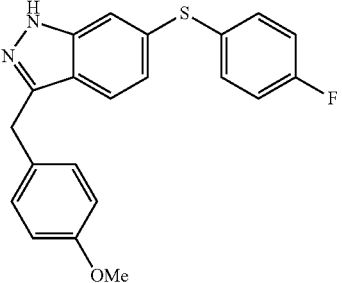 [SMILES: COc1ccc(Cc2n[nH]c3cc(Sc4ccc(F)cc4)ccc23)cc1] |
| | 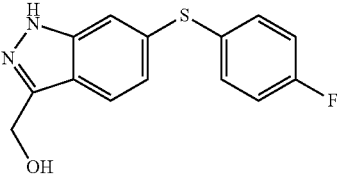 [SMILES: OCc1n[nH]c2cc(Sc3ccc(F)cc3)ccc12] |
| | 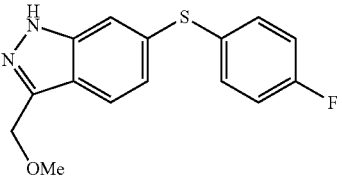 [SMILES: COCc1n[nH]c2cc(Sc3ccc(F)cc3)ccc12] |
| | 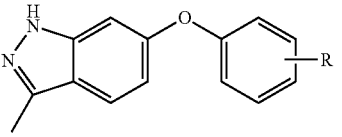<br>18c<br>18c-1: R = 4-Cl<br>18c-2: R = 4-F<br>18c-3: R = 3-Me<br>18c-4: R = 3-F<br>18c-5: R = 3-Cl<br>18c-6: R = 3-SMe<br>18c-7: R = 3-SO$_2$Me<br>18c-8: R = 3-Me, 4-F |
| | 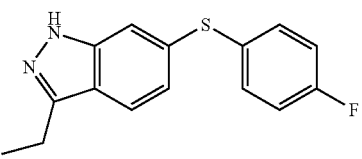 [SMILES: CCc1n[nH]c2cc(Sc3ccc(F)cc3)ccc12] |
| | 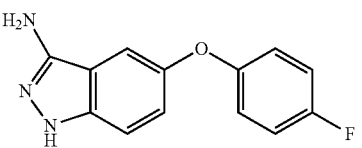 [SMILES: Nc1n[nH]c2ccc(Oc3ccc(F)cc3)cc12] |

TABLE 1-continued
Inhibitors of Mapk14 activity
| name | Chemical name or structure |
|---|---|
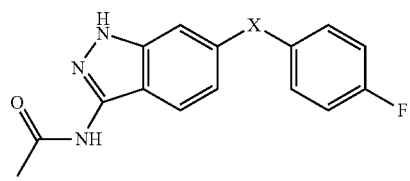
38c
38c-1: X = O
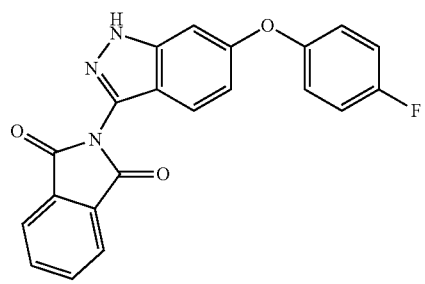 [SMILES: O=C1c2ccccc2C(=O)N1c1n[nH]c2cc(Oc3ccc(F)cc3)ccc12]
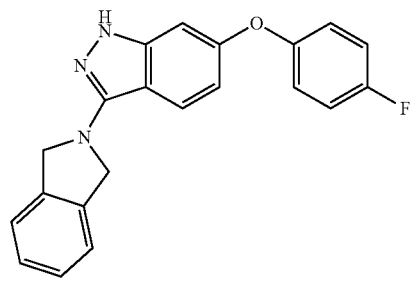 [SMILES: Fc1ccc(Oc2ccc3c(N4Cc5ccccc5C4)n[nH]c3c2)cc1]
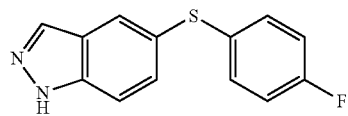 [SMILES: Fc1ccc(Sc2ccc3[nH]ncc3c2)cc1]
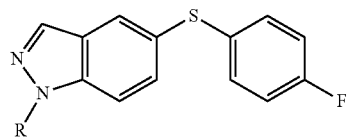
R = CHCH₃CH₃
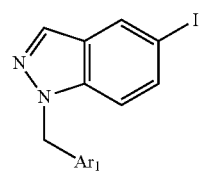
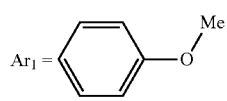

TABLE 1-continued
Inhibitors of Mapk14 activity
| name | Chemical name or structure |
|---|---|
| | 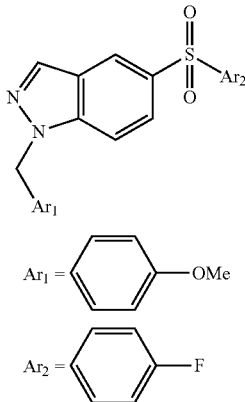 |
| | 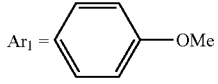 |
| | 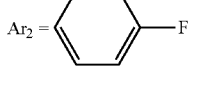 |
| 8e | 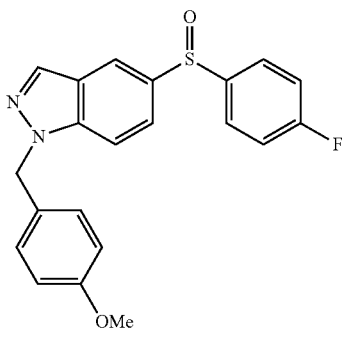 [SMILES: COc1ccc(Cn2ncc3cc(S(=O)c4ccc(F)cc4)ccc32)cc1]  8e-1: $Ar_2$ = Ph |
| 9e | 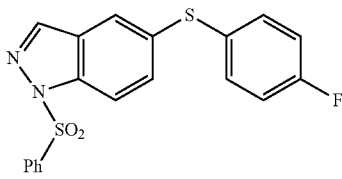 [SMILES: O=S(=O)(c1ccccc1)n1ncc2cc(Sc3ccc(F)cc3)ccc21]  9e-1: $Ar_1$ = Ph    $Ar_2$ = Ph |

TABLE 1-continued

Inhibitors of Mapk14 activity

| name | Chemical name or structure |
|------|----------------------------|

10e 10e-1: Ar₁ = 4-MeO—Ph
Ar₂ = Ph

7f 7f-1: R₁ = CH₂CH(CH₃)₂, R₂ = H, Ar = 2,4-FPh
7f-2: R₁ = CH₂CH(CH₃)₂, R₂ = H, Ar = 4-FPh
7f-3: R₁ = CH₂CH(CH₃)₂, R₂ = Et, Ar = 2,4-FPh
7f-4: R₁ = CH₂CH(CH₃)₂, R₂ = Et, Ar = 4-FPh
7f-5: R₁ = CH₂CH(CH₃)₂, R₂ = CH₂CH₂NHBoc, Ar = 2,4-FPh
7f-6: R₁ = CH₂CH(CH₃)₂, R₂ = CH₂CH₂NHBoc, Ar = 4-FPh
7f-7: R₁ = CH₂CH(CH₃)₂, R₂ = CH₂PH, Ar = 2,4-FPh
7f-8: R₁ = CH₂CH(CH₃)₂, R₂ = CH₂CH₂NH₂, Ar = 2,4-FPh
7f-9: R₁ = CH₂CH(CH₃)₂, R₂ = Me, Ar = 4-FPh
7f-10: R₁ = CH₂CH(CH₃)₂, R₂ = CH₂CH₂NH, Ar = 4-FPh

|       | R1           | R2   | Ar     |
|-------|--------------|------|--------|
| 7f-11 | CH₃          | CH₃  | 2,4 FPh |
| 7f-12 | CH₂CF₃       | H    | 2,4 FPh |
| 7f-13 | CH₂CF₃       | CH₃  | 2,4 FPh |
| 7f-14 | SO₂Me        | H    | 2,4 FPh |
| 7f-15 | SO₂Me        | CH₃  | 2,4 FPh |
| 7f-16 | H            | CH₃  | 2,4 FPh |
| 7f-17 | CH₂CH=CH₂    | H    | 2,4 FPh |
| 7f-18 | CH₂CH=CH₂    | CH₃  | 2,4 FPh |

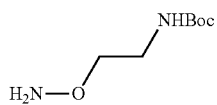

TABLE 1-continued
Inhibitors of Mapk14 activity
| name | Chemical name or structure |
|---|---|
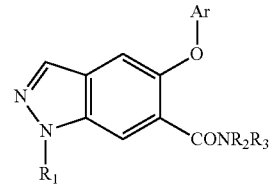
11g
| | R₁ | NR₂R₃ |
|---|---|---|
| 11g-1: | CH₂CH(CH₃)₃ | NH₂ |
| 11g-2: | CH₂CH(CH₃)₃ |  |
| 11g-3: | CH₂CH(CH₃)₃ |  |
| 11g-4: | CH₂CH(CH₃)₃ | 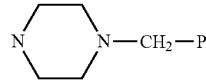 |
| 11g-5: | CH₂CH(CH₃)₃ | 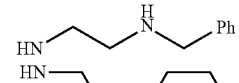 |
| 11g-6: | CH₂CH(CH₃)₃ | 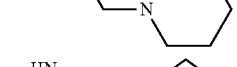 |
| 11g-7: | CH₂CH(CH₃)₃ |  |
| 11g-8: | CH₂CH(CH₃)₃ | 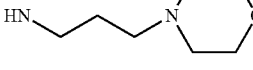 |
| 11g-9: | CH₂CH(CH₃)₃ | 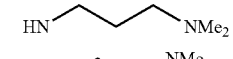 |
| 11g-10: | CH₂CH(CH₃)₃ | 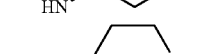 |
| 11g-11: | CH₂CH(CH₃)₃ | 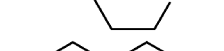 |
| 11g-12: | CH₂CH(CH₃)₃ | 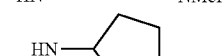 |
| 11g-13: | CH₂CH(CH₃)₃ | 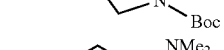 |
| 11g-14: | CH₂CF₃ | 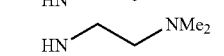 |
| 11g-15: | CH₃ | 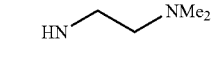 |
| 11g-16: | H |  |

TABLE 1-continued

Inhibitors of Mapk14 activity

| name | Chemical name or structure |
|---|---|

4f 4f-1: $R_1$ = $CH_2CH(CH_3)_2$, Ar = 2,4-FPh
4f-2: $R_1$ = $CH_2CH(CH_3)_2$, Ar = 4-FPh
4f-7: $R_1$ = $CH_2CH(CH_3)_2$, Ar = 2-F, 4-ClPh
4f-8: $R_1$ = $CH_2CH(CH_3)_2$, Ar = 2-Cl, 4-FPh
4f-9: $R_1$ = $CH_2CH(CH_3)_2$, Ar = 2,4-ClPh
4f-10: $R_1$ = $CH_2CH(CH_3)_2$, Ar = 2-MePh

5f 5f-1: R = $CH_2CH(CH_3)_2$, Ar = 2,4-FPh
5f-2: R = $CH_2CH(CH_3)_2$, Ar = 4-FPh
5f-7: R = $CH_2CH(CH_3)_2$, Ar = 2-F, 4-ClPh
5f-8: R = $CH_2CH(CH_3)_2$, Ar = 2-Cl, 4-FPh
5f-9: R = $CH_2CH(CH_3)_2$, Ar = 2,4-ClPh
5f-10: R = $CH_2CH(CH_3)_2$, Ar = 2-MePh
5f-11: R = $CH_2CF_3$, Ar = 2,4 FPh
5f-12: R = $CH_2CH=CH_2$, Ar = 2,4 FPh

2h 2h-1: $R_1$ = $CH_2CH(CH_3)_2$, Ar = 2,4-FPh
2h-2: $R_1$ = $CH_2CH(CH_3)_2$, Ar = 4-FPh
2h-9: $R_1$ = $CH_2CH(CH_3)_2$, Ar = 2,4-ClPh
2h-10: $R_1$ = $CH_2CH(CH_3)_2$, Ar = 2-MePh

TABLE 1-continued
Inhibitors of Mapk14 activity
| name | Chemical name or structure |
|---|---|
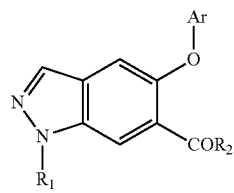
1j
| | R1 | R2 | Ar |
|---|---|---|---|
| 1j-1: | H | HN—CH(CO$_2$Me)—CH$_2$CH$_2$—NHBoc | 4-FPh |
| 1j-2: | H | HN—CH(CO$_2$Me)—CH$_2$CH$_2$—NH$_2$ | 4-FPh |
| 1j-3: | CH$_2$CF$_3$ | HN—CH(CO$_2$Me)—CH$_2$CH$_2$—NHBoc | 4-FPh |
| 1j-4: | CH$_2$CF$_3$ | HN—CH(CO$_2$Me)—CH$_2$CH$_2$—NH$_2$ | 4-FPh |
| 1j-5: | CH$_3$ | HN—CH(CO$_2$Me)—CH$_2$CH$_2$—NHBoc | 4-FPh |
| 1j-6: | CH$_3$ | HN—CH(CO$_2$Me)—CH$_2$CH$_2$—NH$_2$ | 4-FPh |
| 1j-7: | CH$_2$CH(CH$_3$)$_2$ | HN—CH(CO$_2$Me)—CH$_2$CH$_2$—NHBoc | 4-FPh |

TABLE 1-continued

Inhibitors of Mapk14 activity

| name | Chemical name or structure |
|------|----------------------------|

1k

| | R₁ | R₂ | R₃ |
|---|----|----|----|
| 1k-1: | CH₂CH(CH₃)₂ | H | ⁓⁓NMe₂ |
| 1k-2: | CH₂CH(CH₃)₂ | SO₂CH₃ | ⁓⁓NMe₂ |
| 1k-3: | CH₂CH(CH₃)₂ | (C=O)CH₃ | ⁓⁓NMe₂ |

1m 1m-1: R₁ = CH₂CH(CH₃)₂

TABLE 1-continued
Inhibitors of Mapk14 activity
| name | Chemical name or structure |
|------|----------------------------|
|  | 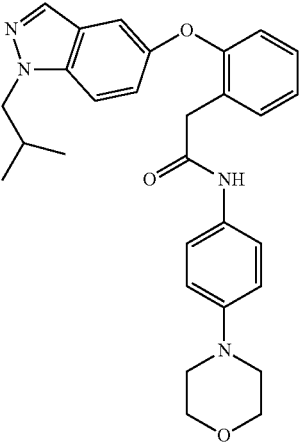 [SMILES: CC(C)Cn1ncc2cc(Oc3ccccc3CC(=O)Nc3ccc(N4CCOCC4)cc3)ccc21] |
|  | 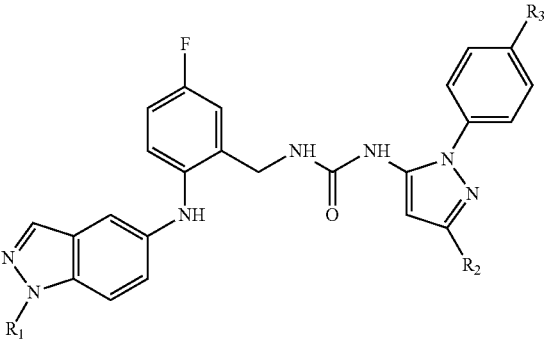<br>9q-1: $R_1$ = $CH_3$; $R_2$ = cyclopropyl; $R_3$ = $CF_3$<br>9q-2: $R_1$ = cyclobutylmethyl; $R_2$ = tBu; $R_3$ = $CH_3$ |
|  | 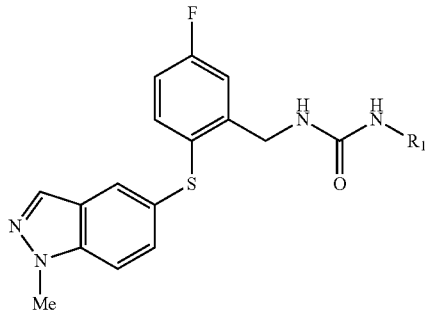<br>6r-1: $R_1$ = 5-cyclopropyl-2-(4′-chlorophenyl)-2H-pyrazol-3-yl<br>6r-2: $R_1$ = 5-t-Butyl-2-(4′-chlorophenyl)-2H-pyrazol-3-yl |
|  | 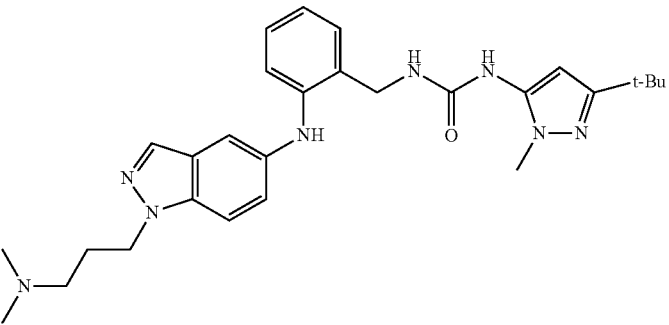 [SMILES: CN(C)CCCn1ncc2cc(Nc3ccccc3CNC(=O)Nc3cc(C(C)(C)C)nn3C)ccc21] |

TABLE 1-continued
Inhibitors of Mapk14 activity
| name | Chemical name or structure |
|------|----------------------------|
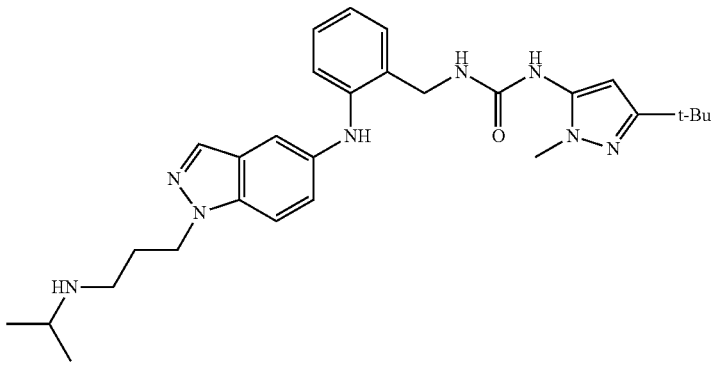 [SMILES: CC(C)NCCCn1ncc2cc(Nc3ccccc3CNC(=O)Nc3cc(C(C)(C)C)nn3C)ccc21]
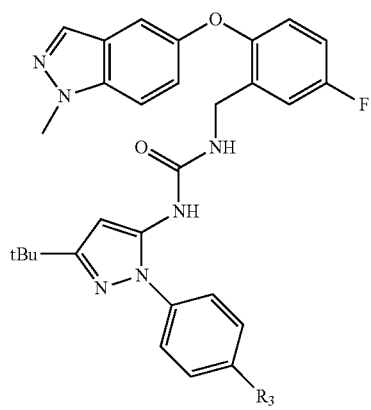
7t-1: R$_3$ = CH$_3$
7t-2: R$_3$ = Cl
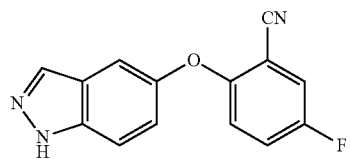 [SMILES: N#Cc1cc(F)ccc1Oc1ccc2[nH]ncc2c1]
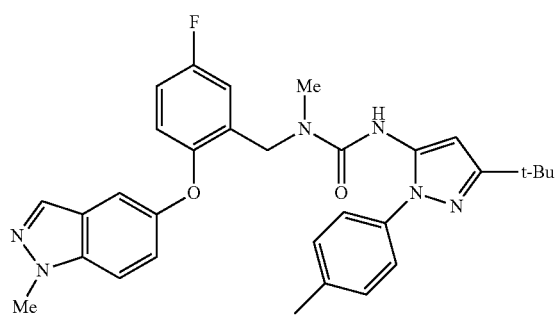 [SMILES: Cc1ccc(-n2nc(C(C)(C)C)cc2NC(=O)N(C)Cc2cc(F)ccc2Oc2ccc3c(cnn3C)c2)cc1]

TABLE 1-continued

Inhibitors of Mapk14 activity

| name | Chemical name or structure |
|------|---------------------------|

7v: R = CH₃

8v: R = —C₆H₄—CH₃ (p-tolyl)

TABLE 1-continued

Inhibitors of Mapk14 activity

| name | Chemical name or structure |
|---|---|

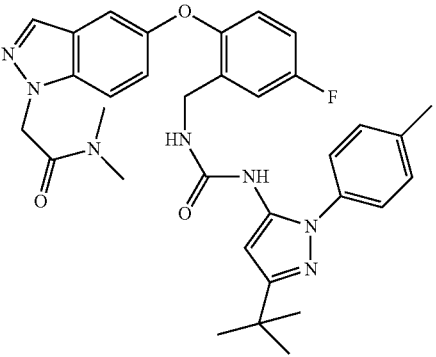

IC50 < 20 nM

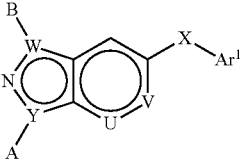

wherein is Y is C, N;
W is C, N, S, or O, provided that W is N, S, or O when Y is C, and W is C or N when Y is N;
U is CH or N;
V is C-E or N;
X is O, S, SO, $SO_2$, $NR^7$, C=O, $CHR^7$, —C=$NOR^1$, —C=$CHR^1$, or $CHOR^1$;
$Ar^1$ is substituted or unsubstituted aryl or heteroaryl;
B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1,

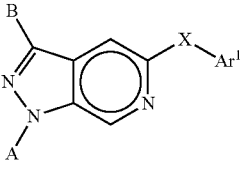

X is O, S, SO, $SO_2$, $NR^7$, C=O, $CHR^7$, —C=$NOR^1$, —C=$CHR^1$, or $CHOR^1$;
B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
n is 0 or 1, TABLE 1-continued Inhibitors of Mapk14 activity

| name | Chemical name or structure |
|---|---|
| | 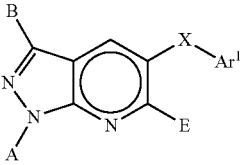 |

X is O, S, SO, $SO_2$, $NR^7$, C=O, $CHR^7$, —C=$NOR^1$, —C=$CHR^1$, or $CHOR^1$;
B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—(C=O)$R^4$, $Z_n$—(C=O)$R^5$, $Z_n$—$NR^5(C=O)R^5$, $Z_n$—O(C=O)$R^5$, $Z_n$—$OR^5$, $Z_n$—$SO_2R^5$, $Z_n$—$SOR^5$, $Z_n$—$SR^5$, $Z_n$—NH(C=O)$NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1,

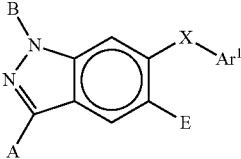

X is O, S, SO, $SO_2$, $NR^7$, C=O, $CHR^7$, —C=$NOR^1$, —C=$CHR^1$, or $CHOR^1$;
B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—(C=O)$R^4$, $Z_n$—(C=O)$R^5$, $Z_n$—$NR^5(C=O)R^5$, $Z_n$—O(C=O)$R^5$, $Z_n$—$OR^5$, $Z_n$—$SO_2R^5$, $Z_n$—$SOR^5$, $Z_n$—$SR^5$, $Z_n$—NH(C=O)$NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1, TABLE 1-continued Inhibitors of Mapk14 activity

| name | Chemical name or structure |
|---|---| where A, B, X, E and $Ar^1$ are as defined above, provided that when B is H and A is $CH=CH-R^8$ where $R^8$ is a substituted or unsubstituted alkyl, alkenyl, cycloalkyl, heterocycloalkyl, aryl, or heteroaryl, then $X-Ar^1$ is a substituent where $Ar^1$ is other than substituted or unsubstituted aryl, heteroaryl, NH-alkyl, NH-cycloalkyl, NH-heterocycloalkyl, NH-aryl, NH-heteroaryl, NH-alkoxy, or NH-dialkylamide when X is O, S, C=O, S=O, $C=CH_2$, $CO_2$, NH, or $N(C_1-C_8\text{-alkyl})$.

[Chemical structure: benzisoxazole with substituents A, X-$Ar^1$, E]

X is O, S, SO, $SO_2$, $NR^7$, C=O, $CHR^7$, $-C=NOR^1$, $-C=CHR^1$, or $CHOR^1$;
A is H, OH, an amine protecting group, $Z_n-NR^2R^3$, $Z_n-NR^2(C=O)R^2$, $Z_n-SO_2R^2$, $Z_n-SOR^2$, $Z_n-SR^2$, $Z_n-OR^2$, $Z_n-(C=O)R^2$, $Z_n-(C=O)OR^2$, $Z_n-O-(C=O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n-NR^2R^3$, $Z_n-(C=O)R^4$, $Z_n-(C=O)R^5$, $Z_n-NR^5(C=O)R^5$, $Z_n-O(C=O)R^5$, $Z_n-OR^5$, $Z_n-SO_2R^5$, $Z_n-SOR^5$, $Z_n-SR^5$, $Z_n-NH(C=O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted;
n is 0 or 1,

[Chemical structure: indazole with substituents B, A, O-$Ar^1$, E]

B is H, $NH_2$, or substituted or unsubstituted methyl;
A is H, OH, an amine protecting group, $Z_n-NR^2R^3$, $Z_n-NR^2(C=O)R^2$, $Z_n-SO_2R^2$, $Z_n-SOR^2$, $Z_n-SR^2$, $Z_n-OR^2$, $Z_n-(C=O)R^2$, $Z_n-(C=O)OR^2$, $Z_n-O-(C=O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n-NR^2R^3$, $Z_n-(C=O)R^4$, $Z_n-(C=O)R^5$, $Z_n-NR^5(C=O)R^5$, $Z_n-O(C=O)R^5$, $Z_n-OR^5$, $Z_n-SO_2R^5$, $Z_n-SOR^5$, $Z_n-SR^5$, $Z_n-NH(C=O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n-Ar^1$ may be substituted or unsubstituted;
n is 0 or 1, TABLE 1-continued Inhibitors of Mapk14 activity

| name | Chemical name or structure |
|---|---|

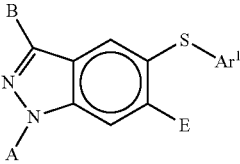

B is H, $NH_2$, or substituted or unsubstituted methyl;
A is H, OH, an amine protecting group, $Z_n$—$NR^2R^3$, $Z_n$—$NR^2(C$=$O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—(C=O)$R^4$, $Z_n$—(C=O)$R^5$, $Z_n$—$NR^5(C$=$O)R^5$, $Z_n$—O(C=O)$R^5$, $Z_n$—$OR^5$, $Z_n$—$SO_2R^5$, $Z_n$—$SOR^5$, $Z_n$—$SR^5$, $Z_n$—NH(C=O)$NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1,

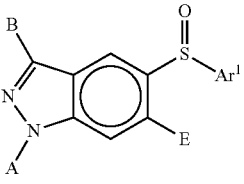

B is H, $NH_2$, or substituted or unsubstituted methyl;
A is H, OH, an amine protecting group, $Z_n$—$NR^2R^3$, $Z_n$—$NR^2(C$=$O)R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—(C=O)$R^4$, $Z_n$—(C=O)$R^5$, $Z_n$—$NR^5(C$=$O)R^5$, $Z_n$—O(C=O)$R^5$, $Z_n$—$OR^5$, $Z_n$—$SO_2R^5$, $Z_n$—$SOR^5$, $Z_n$—$SR^5$, $Z_n$—NH(C=O)$NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1, TABLE 1-continued Inhibitors of Mapk14 activity

| name | Chemical name or structure |
|---|---|

[Structure: indazole with substituent B at 3-position, A on N1, and a sulfonyl group ($SO_2Ar^1$) on the benzene ring, with E substituent]

B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—$(C=O)R^2$, $Z_n$—$(C=O)OR^2$, $Z_n$—O—$(C=O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—$(C=O)R^4$, $Z_n$—$(C=O)R^5$, $Z_n$—$NR^5(C=O)R^5$, $Z_n$—$O(C=O)R^5$, $Z_n$—$OR^5$, $Z_n$—$SO_2R^5$, $Z_n$—$SOR^5$, $Z_n$—$SR^5$, $Z_n$—$NH(C=O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1,

[Structure: indazole with substituent B at 3-position, A on N1, and a CH(OH)$Ar^1$ group on the benzene ring, with E substituent]

B is H, $NH_2$, or substituted or unsubstituted methyl;
A is H, OH, an amine protecting group, $Z_n$—$NR^2R^3$, $Z_n$—$NR^2(C=O)R^2$, $Z_n$—$SO_2R^2$, $Z_n$—$SOR^2$, $Z_n$—$SR^2$, $Z_n$—$OR^2$, $Z_n$—$(C=O)R^2$, $Z_n$—$(C=O)OR^2$, $Z_n$—O—$(C=O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, Zn-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—$(C=O)R^4$, $Z_n$—$(C=O)R^5$, $Z_n$—$NR^5(C=O)R^5$, $Z_n$—$O(C=O)R^5$, $Z_n$—$OR^5$, $Z_n$—$SO_2R^5$, $Z_n$—$SOR^5$, $Z_n$—$SR^5$, $Z_n$—$NH(C=O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1, TABLE 1-continued Inhibitors of Mapk14 activity

| name | Chemical name or structure |
| --- | --- |

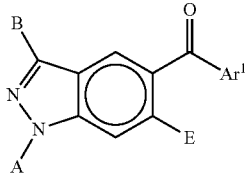

B is H, $NH_2$, or substituted or unsubstituted methyl;
A is H, OH, an amine protecting group, $Z_n$—$NR^2R^3$, $Z_n$—$NR^2(C$=$O)R^2$, $Z_n$—$SO_2R^2$, $Z_n$—$SOR^2$, $Z_n$—$SR^2$, $Z_n$—$OR^2$, $Z_n$—$(C$=$O)R^2$, $Z_n$—$(C$=$O)OR^2$, $Z_n$—$O$—$(C$=$O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—$(C$=$O)R^4$, $Z_n$—$(C$=$O)R^5$, $Z_n$—$NR^5(C$=$O)R^5$, $Z_n$—$O(C$=$O)R^5$, $Z_n$—$OR^5$, $Z_n$—$SO_2R^5$, $Z_n$—$SOR^5$, $Z_n$—$SR^5$, $Z_n$—$NH(C$=$O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
n is 0 or 1,

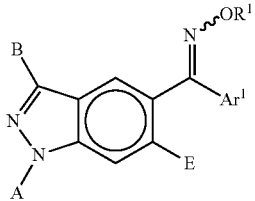

B is H, $NH_2$, or substituted or unsubstituted methyl;
A is H, OH, an amine protecting group, $Z_n$—$NR^2R^3$, $Z_n$—$NR^2(C$=$O)R^2$, $Z_n$—$SO_2R^2$, $Z_n$—$SOR^2$, $Z_n$—$SR^2$, $Z_n$—$OR^2$, $Z_n$—$(C$=$O)R^2$, $Z_n$—$(C$=$O)OR^2$, $Z_n$—$O$—$(C$=$O)R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
E is H, $Z_n$—$NR^2R^3$, $Z_n$—$(C$=$O)R^4$, $Z_n$—$(C$=$O)R^5$, $Z_n$—$NR^5(C$=$O)R^5$, $Z_n$—$O(C$=$O)R^5$, $Z_n$—$OR^5$, $Z_n$—$SO_2R^5$, $Z_n$—$SOR^5$, $Z_n$—$SR^5$, $Z_n$—$NH(C$=$O)NHR^5$, or $R^5$;
$R^4$ is a substituted or unsubstituted natural or unnatural amino acid, a protected natural or unnatural amino acid, $NH(CHR^6)(CH_2)_mOR^5$ where m is an integer from 1 to 4, or $NR^2R^3$;
$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;

TABLE 1-continued

Inhibitors of Mapk14 activity

| name | Chemical name or structure |
|---|---|

R$^1$ is H, PO$_3$H$_2$, SO$_3$H$_2$, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted;
n is 0 or 1,

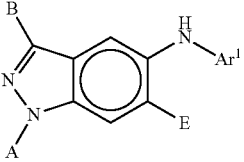

B is H, NH$_2$, or substituted or unsubstituted methyl;
A is H, OH, an amine protecting group, Z$_n$—NR$^2$R$^3$, Z$_n$—NR$^2$(C=O)R$^2$, Z$_n$—SO$_2$R$^2$, Z$_n$—SOR$^2$, Z$_n$—SR$^2$, Z$_n$—OR$^2$, Z$_n$—(C=O)R$^2$, Z$_n$—(C=O)OR$^2$, Z$_n$—O—(C=O)R$^2$, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted;
Ar$^1$ is substituted or unsubstituted aryl or heteroaryl;
R$^2$ and R$^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted, or R$^2$ together with R$^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
Ar$^1$ is substituted or unsubstituted aryl or heteroaryl;
E is H, Z$_n$—NR$^2$R$^3$, Z$_n$—(C=O)R$^4$, Z$_n$—(C=O)R$^5$, Z$_n$—NR$^5$(C=O)R$^5$, Z$_n$—O(C=O)R$^5$, Z$_n$—OR$^5$, Z$_n$—SO$_2$R$^5$, Z$_n$—SOR$^5$, Z$_n$—SR$^5$, Z$_n$—NH(C=O)NHR$^5$, or R$^5$;
R$^4$ is a substituted or unsubstituted natural or unnatural amino acid, a protected natural or unnatural amino acid, NH(CHR$^6$)(CH$_2$)$_m$OR$^5$ where m is an integer from 1 to 4, or NR$^2$R$^3$;
R$^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted;
n is 0 or 1,

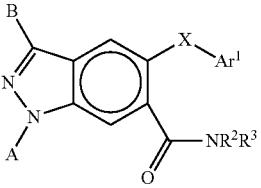

B is H, NH$_2$, or substituted or unsubstituted methyl;
A is H, OH, an amine protecting group, Z$_n$—NR$^2$R$^3$, Z$_n$—NR$^2$(C=O)R$^2$, Z$_n$—SO$_2$R$^2$, Z$_n$—SOR$^2$, Z$_n$—SR$^2$, Z$_n$—OR$^2$, Z$_n$—(C=O)R$^2$, Z$_n$—(C=O)OR$^2$, Z$_n$—O—(C=O)R$^2$, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted;
Ar$^1$ is substituted or unsubstituted aryl or heteroaryl;
R$^2$ and R$^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$, wherein said alkyl, allyl, alkenyl, alkynyl, heteroalkyl, heteroallyl, heteroalkenyl, heteroalkynyl, alkoxy, heteroalkoxy, Z$_n$-cycloalkyl, Z$_n$-heterocycloalkyl, or Z$_n$—Ar$^1$ may be substituted or unsubstituted, or R$^2$ together with R$^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
Ar$^1$ is substituted or unsubstituted aryl or heteroaryl;
R$^4$ is a substituted or unsubstituted natural or unnatural amino acid, a protected natural or unnatural amino acid, NH(CHR$^6$)(CH$_2$)$_m$OR$^5$ where m is an integer from 1 to 4, or NR$^2$R$^3$;

TABLE 1-continued

Inhibitors of Mapk14 activity

| name | Chemical name or structure |
|---|---|

$R^5$ is H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;

X is O, S, SO, $SO_2$, $NR^7$, C=O, $CHR^7$, —C=$NOR^1$, —C=$CHR^1$, or $CHOR^1$;

n is 0 or 1,

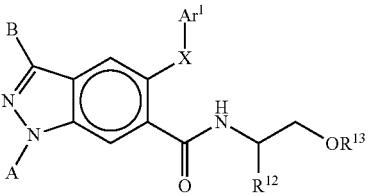

B is H, $NH_2$, or substituted or unsubstituted methyl;
A is H, OH, an amine protecting group, $Z_n$—$NR^2R^3$, $Z_n$—$NR^2$(C=O)$R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$Ar^1$ is substituted or unsubstituted aryl or heteroaryl;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
X is O, S, SO, $SO_2$, $NR^7$, C=O, $CHR^7$, —C=$NOR^1$, —C=$CHR^1$, or $CHOR^1$;
where A, B, X, and $Ar^1$ are defined as above, and $R^{12}$ and $R^{13}$ are independently alkyl, allyl, alkenyl, alkynyl, cycloalkyl, heterocycloalkyl, aryl, or heteroaryl, wherein said alkyl, allyl, alkenyl, alkynyl, cycloalkyl, heterocycloalkyl, aryl, or heteroaryl may be substituted or unsubstituted.
n is 0 or 1,

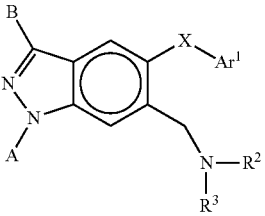

B is H, $NH_2$, or substituted or unsubstituted methyl;
A is H, OH, an amine protecting group, $Z_n$—$NR^2R^3$, $Z_n$—$NR^2$(C=O)$R^2$, $Z_n$—$SO_2R^2$, $Z_n$—$SOR^2$, $Z_n$—$SR^2$, $Z_n$—$OR^2$, $Z_n$—(C=O)$R^2$, $Z_n$—(C=O)$OR^2$, $Z_n$—O—(C=O)$R^2$, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted;
$R^2$ and $R^3$ are independently H, OH, an amine protecting group, an alcohol protecting group, an acid protecting group, a thio protecting group, alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, or $Z_n$—$Ar^1$ may be substituted or unsubstituted, or $R^2$ together with $R^3$ and N forms a saturated or partially unsaturated heterocycle having 1 or more heteroatoms, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
$Ar^1$ is substituted or unsubstituted aryl or heteroaryl;
X is O, S, SO, $SO_2$, $NR^7$, C=O, $CHR^7$, —C=$NOR^1$, —C=$CHR^1$, or $CHOR^1$;
n is 0 or 1, TABLE 1-continued Inhibitors of Mapk14 activity

| name | Chemical name or structure |
|------|---------------------------|

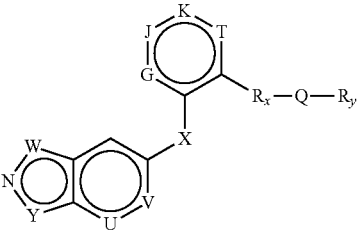

where Y is $CR^1$, O, S, or $NR^2$;
W is $CR^3$, N, $NR^4$, S or O, provided that W is $NR^4$, S, or O when Y is $CR^1$ and W is $CR^3$ or N when Y is $NR^2$;
$R^3$ is H, $NH_2$, F, Cl, methyl or substituted methyl;
$R^4$ is H, or methyl or substituted methyl;
$R^1$ and $R^2$ are independently H, OH, an amine protecting group, $Z_n$—$NR^aR^b$, $Z_n$—$NR^a(C=O)R^b$, $Z_n$—$SO_2R^a$, $Z_n$—$SOR^a$, $Z_n$—$SR^a$, $Z_n$—$OR^a$, $Z_n$—$(C=O)R^a$, $Z_n$—$(C=O)OR^a$, $Z_n$—O—$(C=O)R^a$, alkyl, allyl, alkenyl, alkynyl, heteroalkyl, heteroallyl, heteroalkenyl, heteroalkynyl, alkoxy, heteroalkoxy, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, and $Z_n$—$Ar^1$ may be substituted or unsubstituted;
$Ar^1$ is aryl or heteroaryl, each of which may be substituted or unsubstituted;
$R^a$ and $R^b$ are independently H, OH, an amine protecting group, an alcohol protecting group, an acid protecting group, a sulfur protecting group, alkyl, allyl, alkenyl, alkynyl, heteroalkyl, heteroallyl, heteroalkenyl, heteroalkynyl, alkoxy, heteroalkoxy, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, and $Z_n$—$Ar^1$ may be substituted or unsubstituted,
or $R^a$ and $R^b$ together with the atoms to which they are both attached form a saturated or partially unsaturated heterocycle ring having 1 or more heteroatoms in said ring, wherein said heterocycle may be substituted or unsubstituted and wherein said heterocycle may be fused to an aromatic ring;
Z is alkylene having from 1 to 4 carbons, or alkenylene or alkynylene each having from 2 to 4 carbons, wherein said alkylene, alkenylene, or alkynylene may be substituted or unsubstituted;
n is 0 or 1;
U is $CR^c$ or N;
V is $CR^c$ or N;
$R^c$ is H, F, Cl, methyl or substituted methyl;
X is O, S, SO, $SO_2$, $NR^5$, C=O, $CH_2$, $CH_2Z_n$—OH, or C=$NOR^d$;
$R^5$ is H, methyl, or substituted methyl;
$R^d$ is H, $PO_3H_2$, $SO_3H_2$, alkyl, allyl, alkenyl, alkynyl, heteroalkyl, heteroallyl, heteroalkenyl, heteroalkynyl, alkoxy, heteroalkoxy, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl and $Z_n$—$Ar^1$ may be substituted or unsubstituted;
G, H, J, and T independently are N or $CR^z$, provided that when any of said G, H, J, and T are N the total number of G, H, J, or T that is N does not exceed 2;
$R^z$ is H, F, Cl, Br, $CF_3$, $OR^6$, $SR^6$, lower alkyl ($C_1$-$C_4$), CN, or $NR^6R^7$;
$R^6$ and $R^7$ are independently H, $CF_3$, lower alkyl ($C_1$-$C_4$) or lower heteroalkyl ($C_1$-$C_4$);
Q is —$NR^8$CONH—, —NHCO—, —$NR^8SO_2$NH—, —$NHSO_2$—, —$CONR^{11}$—;
$R^8$ is H or lower ($C_1$-$C_4$) alkyl;
$R^{11}$ is H or lower ($C_1$-$C_4$) alkyl;
$R_x$ is —$(CR^9R^{10})_m$—, —$O(CR^9R^{10})_m$—, $NH(CR^9R^{10})_m$—, or —$S(CR^9R^{10})_m$-provided that Q is —$CONR^{11}$— when $R^x$ is —$O(CR^9R^{10})_m$—, —$NH(CR^9R^{10})_m$—, or —$S(CR^9R^{10})_m$—;
$R^9$ and $R^{10}$ are independently H, or lower alkyl, or $R^9$ and $R^{10}$ together with the atoms to which they are both attached form a cycloalkyl ring which may be saturated or partially unsaturated;
m is 1-3;
$R_y$ is H, $PO_3H$, an amine protecting group, an oxygen protecting group, alkyl, allyl, alkenyl, alkynyl, heteroalkyl, heteroallyl, heteroalkenyl, heteroalkynyl, alkoxy, heteroalkoxy, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^2$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$—$Ar^2$ and $Z_n$-heterocycloalkyl may be substituted or unsubstituted;
$Ar^2$ is aryl or heteroaryl, each of which may be substituted or unsubstituted, wherein said substitution can be 1-3 substituents independently selected from F, Cl, Br, $CF_3$, CN, alkyl, allyl, alkenyl, alkynyl, heteroalkyl, heteroallyl, heteroalkenyl, heteroalkynyl, —$OR^{12}$, —$SR^{12}$, —$SO_2R^{12}$, —$SO_2NR^{13}R^{12}$, $NR^{13}SO_2R^{12}$, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl and $Z_n$—$Ar^1$ may be substituted or unsubstituted;
$R^{12}$ and $R^{13}$ are independently H, alkyl, allyl, alkenyl, alkynyl, heteroalkyl, heteroallyl, heteroalkenyl, heteroalkynyl, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl and $Z_n$—$Ar^1$ may be substituted or unsubstituted;
wherein when $Ar^2$ is substituted with —$SO_2NR^{13}R^{12}$, $R^{12}$ and $R^{13}$ can form a cycloalkyl ring or heterocycloalkyl ring that may be substituted or unsubstituted wherein said substitution can be substituents selected from alkyl, allyl, alkenyl, alkynyl, heteroalkyl, heteroallyl, heteroalkenyl, heteroalkynyl, alkoxy, heteroalkoxy, $Z_n$-cycloalkyl wherein

TABLE 1-continued

Inhibitors of Mapk14 activity

| name | Chemical name or structure |
|------|----------------------------|
| | said cycloalkyl is saturated or partially unsaturated, —$COR^{12}$, —$SO_2R^{12}$, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl and $Z_n$—$Ar^1$ may be substituted or unsubstituted;<br>wherein when Q is —$CONR^{11}$, $R_y$ in combination with $R^{11}$ is additionally cycloalkyl ring or heterocycloalkyl ring that may be substituted or unsubstituted with groups selected from alkyl, allyl, alkenyl, alkynyl, heteroalkyl, heteroallyl, heteroalkenyl, heteroalkynyl, alkoxy, heteroalkoxy, $Z_n$-cycloalkyl wherein said cycloalkyl is saturated or partially unsaturated, $Z_n$-heterocycloalkyl wherein said heterocycloalkyl is saturated or partially unsaturated, $Z_n$—$Ar^1$, —$COR^{14}$, or —$SO_2R^{14}$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, $Z_n$—$Ar^1$, —$COR^{14}$, and —$SO_2R^{14}$ may be substituted or unsubstituted; and<br>$R^{14}$ is alkyl, allyl, alkenyl, alkynyl, heteroalkyl, heteroallyl, heteroalkenyl, heteroalkynyl, $Z_n$-cycloalkyl wherein said cycloalkyl is saturated or partially unsaturated, $Z_n$-heterocycloalkyl wherein said heterocycloalkyl is saturated or partially unsaturated, or $Z_n$—$Ar^1$, wherein said alkyl, allyl, alkenyl, alkynyl, heteroalkyl, heteroallyl, heteroalkenyl, heteroalkynyl, alkoxy, heteroalkoxy, $Z_n$-cycloalkyl, $Z_n$-heterocycloalkyl, and $Z_n$—$Ar^1$ may be substituted or unsubstituted.<br>n is 0 or 1,<br><br>5-(4-fluorophenoxy)-1-isobutyl-1H-indazole-6-carboxylic acid amide<br>[5-(4-fluorophenoxy)-1-isobutyl-1H-indazol-6-yl]morpholin-4-yl-methanone<br>[5-(4-fluorophenoxy)-1-isobutyl-1H-indazol-6-yl]-(4-methylpiperazin-1-yl)-methanone<br>5-(4-fluorophenoxy)-1-isobutyl-1H-indazole-6-carboxylic acid (1-benzyl-piperidin-4-yl)amide<br>5-(4-fluorophenoxy)-1-isobutyl-1H-indazole-6-carboxylic acid (2-benzylaminoethyl)amide<br>5-(4-fluorophenoxy)-1-isobutyl-1H-indazole-6-carboxylic acid (2-piperidin-yl-ethyl)amide<br>5-(4-fluorophenoxy)-1-isobutyl-1H-indazole-6-carboxylic acid (2-pyrrolidin-1-yl-ethyl)amide<br>5-(4-fluorophenoxy)-1-isobutyl-1H-indazole-6-carboxylic acid (3-morpholin-4-yl-propyl)amide<br>5-(4-fluorophenoxy)-1-isobutyl-1H-indazole-6-carboxylic acid (3-demethylaminopropyl)amide<br>5-(4-fluorophenoxy)-1-isobutyl-1H-indazole-6-carboxylic acid (2-dimethylaminoethyl)amide<br>5-(4-fluorophenoxy)-1-isobutyl-1H-indazole-6-carboxylic acid methyl-(1-methylpiperidin-4-yl)amide<br>5-(4-fluorophenoxy)-1-isobutyl-1H-indazole-6-carboxylic acid [3-(methylphenylamino)-propyl]amide<br>3-{[5-(4-fluorophenoxy)-1-isobutyl-1H-indazole-6-carbonyl]-amino}-pyrrolidine-1-carboxylic acid tert-butyl ester<br>5-(4-fluorophenoxy)-1-(2,2,2-trifluoroethyl)-1H-indazole-6-carboxylic acid (2-dimethylaminoethyl)amide<br>5-(4-fluorophenoxy)-1-methyl-1H-indazole-6-carboxylic acid (2-dimethyl-aminoethyl)amide<br>5-(4-fluorophenoxy)-1H-indazole-6-carboxylic acid (2-dimethyl-aminoethyl)amide<br>4-amino-2-{[5-(4-fluorophenoxy)-1-isobutyl-1H-indazole-6-carbonyl]-amino} butyric acid methyl ester<br>4-amino-2-{[5-(4-fluorophenoxy)-1-(2,2,2-trifluoroethyl)-1H-indazole-6-carbonyl]-amino} butyric acid methyl ester<br>4-amino-2-{[5-(4-fluorophenoxy)-1-methyl-1H-indazole-6-carbonyl]-amino} butyric acid methyl ester<br>(S)-N-(4-amino-1-hydroxybutan-2-yl)5-(4-fluorophenoxy)-1-isobutyl-1H-indazole-6-carboxamide<br>(S)-methyl 2-(5-(2,4-difluorophenoxy)-1-isobutyl-1H-indazole-6-carboxamido)-4-(dimethylamino)butanoate<br>(S)-5-(2,4-difluorophenoxy)-N-(4-(dimethylamino)-1-hydroxybutan-2-yl)-1-isobutyl-1H-indazole-6-carboxamide<br>(S)-5-(2,4-difluorophenoxy)-1-isobutyl-1H-indazole-6-carboxylic acid (1-hydroxymethyl-3-isopropylaminopropyl)amide<br>(S)-2-{[5-(2,4-difluorophenoxy)-1-isobutyl-1H-indazole-6-carbonyl]-amino}-4-dimethylaminobutyric acid<br>(S)-5-(2,4-difluorophenoxy)-1-isobutyl-1H-indazole-6-carboxylic acid (1-hydroxymethyl-3-piperidin-1-yl-propyl)amide<br>(S)-5-(2,4-difluorophenoxy)-1-isobutyl-1H-indazole-6-carboxylic acid (3-dimethylamino-1-dimethylcarbamoyl-propyl)amide<br>(S)-5-(2,4-difluorophenoxy)-1-isobutyl-1H-indazole-6-carboxylic acid (1-carbamoyl-3-dimethylaminopropyl)amide<br>(S)-5-(2,4-difluorophenoxy)-1-isobutyl-1H-indazole-6-carboxylic acid [1-(2-dimethylaminoethyl-2-hydroxy-2-methylpropyl]amide<br>(S)-5-(2,4-difluorophenoxy)-1-isobutyl-1H-indazole-6-carboxylic acid (1-hydroxymethyl-3-[(2-methoxyethyl)methyl-amino]propyl}amide<br>(S)-5-(2,4-difluorophenoxy)-1-isobutyl-1H-indazole-6-carboxylic acid [3-dimethylamino-1-(2-hydroxyethyl-carbamoyl)propyl]amide<br>5-(2,4-difluorophenoxy)-1-isobutyl-1H-indazole-6-sulfonic acid (3-dimethylaminopropyl) amide<br>(S)-methyl 2-(5-(2,4-difluorophenoxy)-1-isobutyl-1H-indazole-6-sulfonamido)-4-(dimethylamino)butanoate<br>5-(2,4-difluorophenoxy)-1-isobutyl-1H-indazole-6-sulfonic acid [2-(1-methylpyrrolidin-2-yl)-ethyl]amide<br>5-(2,4-difluorophenoxy)-1-isobutyl-1H-indazole-6-sulfonic acid [2-dimethylaminoethyl)amide<br>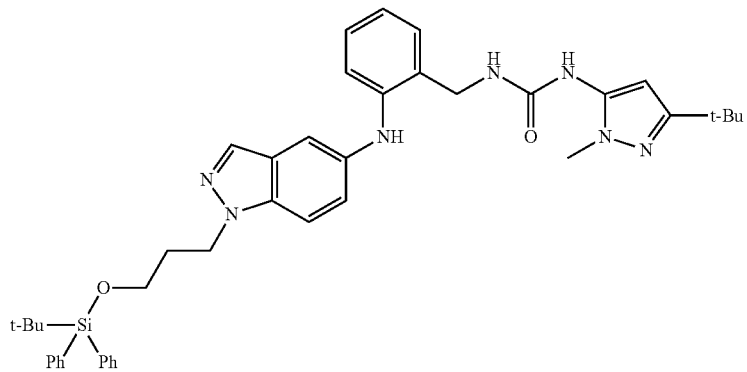 [SMILES: Cn1nc(C(C)(C)C)cc1NC(=O)NCc1ccccc1Nc1ccc2c(cnn2CCCO[Si](c2ccccc2)(c2ccccc2)C(C)(C)C)c1] |

TABLE 1-continued
Inhibitors of Mapk14 activity
| name | Chemical name or structure |
|---|---|
| | 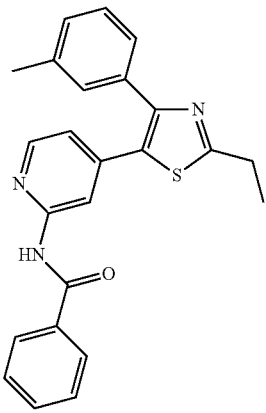 [SMILES: CCc1nc(-c2cccc(C)c2)c(-c2ccnc(NC(=O)c3ccccc3)c2)s1] |
| | 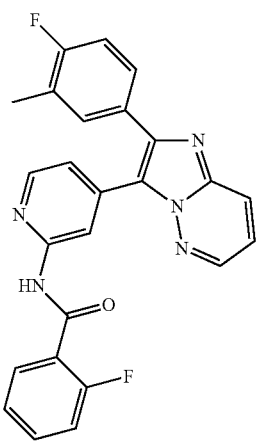 [SMILES: Cc1cc(-c2nc3cccnn3c2-c2ccnc(NC(=O)c3ccccc3F)c2)ccc1F] |
| | 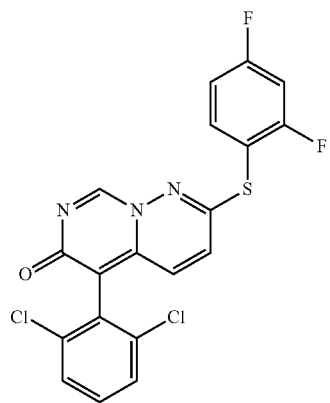<br>IC50 = 5 nM, |

TABLE 1-continued
Inhibitors of Mapk14 activity
| name | Chemical name or structure |
|---|---|
| | 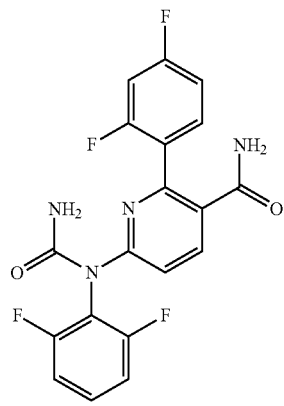 [SMILES: NC(=O)c1ccc(N(C(N)=O)c2c(F)cccc2F)nc1-c1ccc(F)cc1F] |
| | 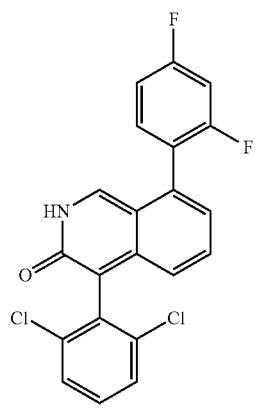 [SMILES: O=c1[nH]cc2c(-c3ccc(F)cc3F)cccc2c1-c1c(Cl)cccc1Cl] |
| | 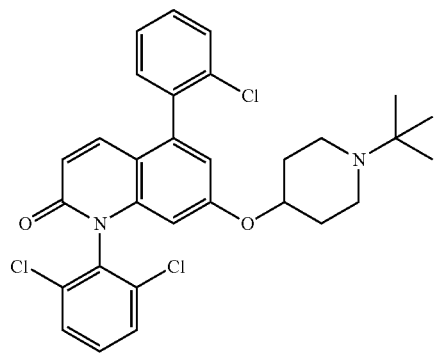 [SMILES: CC(C)(C)N1CCC(Oc2cc(-c3ccccc3Cl)c3ccc(=O)n(-c4c(Cl)cccc4Cl)c3c2)CC1] |

TABLE 1-continued
Inhibitors of Mapk14 activity
| name | Chemical name or structure |
| --- | --- |
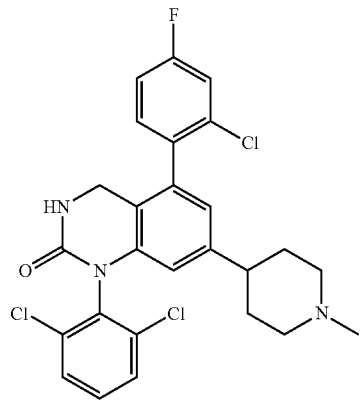
IC50 p38 α = 0.5 nM (kinase enzyme assay)
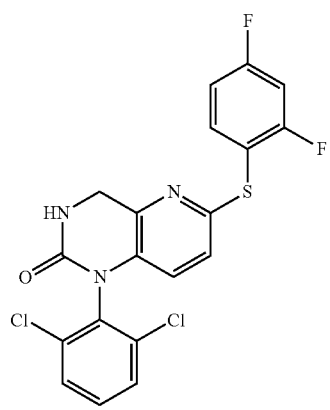 [SMILES: O=C1NCc2nc(Sc3ccc(F)cc3F)ccc2N1c1c(Cl)cccc1Cl]
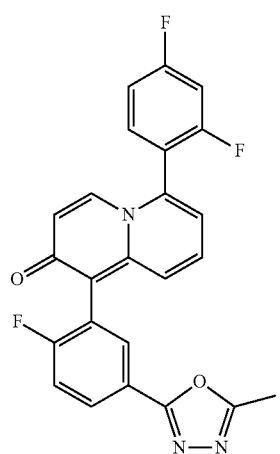
IC50 p38α = 15 nM TABLE 1-continued
Inhibitors of Mapk14 activity
| name | Chemical name or structure |
| --- | --- |
| | 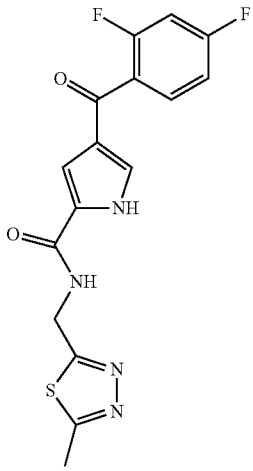 [SMILES: Cc1nnc(CNC(=O)c2cc(C(=O)c3ccc(F)cc3F)c[nH]2)s1] |
| | 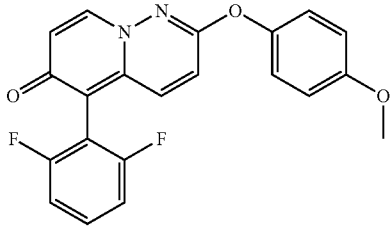 [SMILES: COc1ccc(Oc2ccc3c(-c4c(F)cccc4F)c(=O)ccn3n2)cc1] |
| | 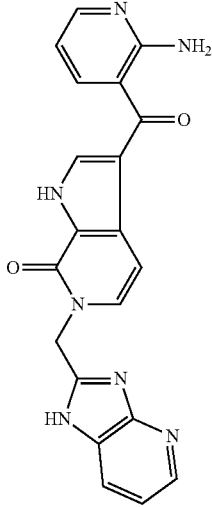 [SMILES: Nc1ncccc1C(=O)c1c[nH]c2c(=O)n(Cc3nc4ncccc4[nH]3)ccc12] |
| | 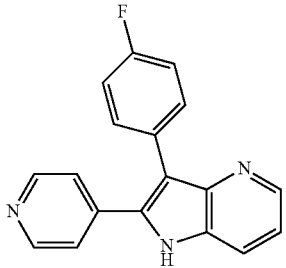 [SMILES: Fc1ccc(-c2c(-c3ccncc3)[nH]c3cccnc23)cc1] |

163 164
TABLE 1-continued
Inhibitors of Mapk14 activity
| name | Chemical name or structure |
|---|---|
| | 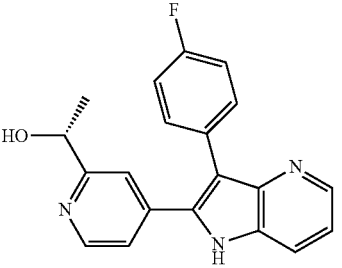 [SMILES: C[C@@H](O)c1cc(-c2[nH]c3cccnc3c2-c2ccc(F)cc2)ccn1] |
| | 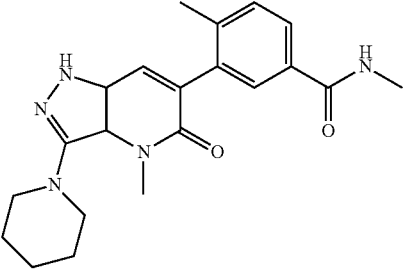 [SMILES: CNC(=O)c1ccc(C)c(C2=CC3NN=C(N4CCCCC4)C3N(C)C2=O)c1] |
| | 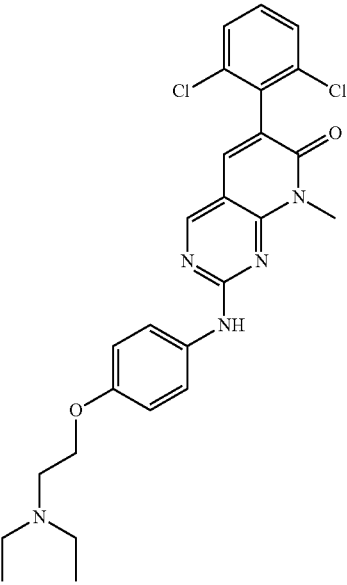 [SMILES: CCN(CC)CCOc1ccc(Nc2ncc3cc(-c4c(Cl)cccc4Cl)c(=O)n(C)c3n2)cc1] |
| | 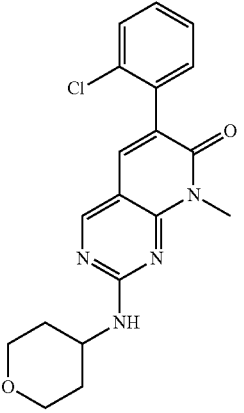 [SMILES: Cn1c(=O)c(-c2ccccc2Cl)cc2cnc(NC3CCOCC3)nc21] |

TABLE 1-continued
Inhibitors of Mapk14 activity
| name | Chemical name or structure |
|---|---|
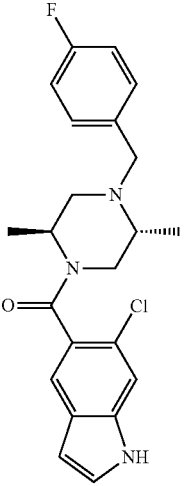
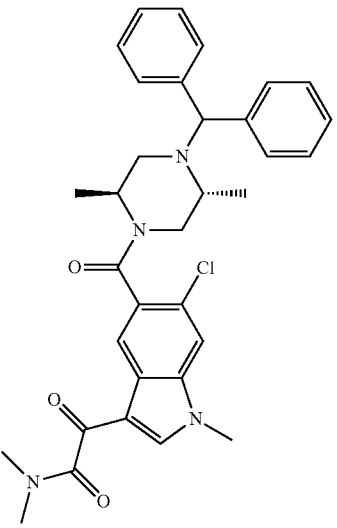 [SMILES: C[C@@H]1CN(C(=O)c2cc3c(C(=O)C(=O)N(C)C)cn(C)c3cc2Cl)[C@@H](C)CN1C(c1ccccc1)c1ccccc1]
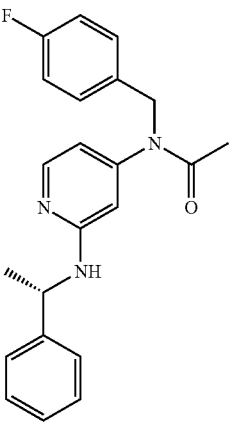 [SMILES: CC(=O)N(Cc1ccc(F)cc1)c1ccnc(N[C@@H](C)c2ccccc2)c1]

TABLE 1-continued
Inhibitors of Mapk14 activity
| name | Chemical name or structure |
|------|---------------------------|
|  | 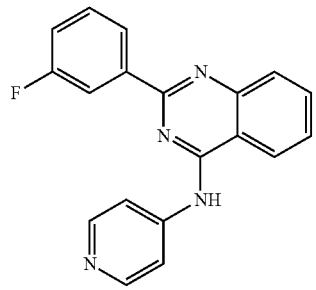 [SMILES: Fc1cccc(-c2nc(Nc3ccncc3)c3ccccc3n2)c1] |
|  | 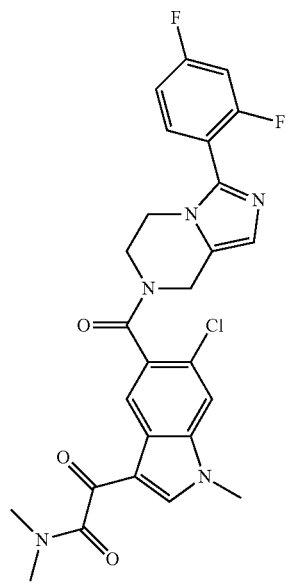<br>IC50 p38α = 11 nM |
|  | 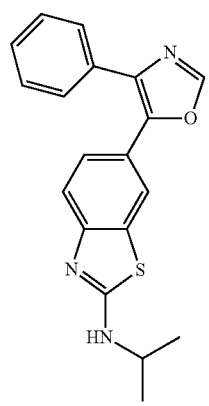 [SMILES: CC(C)Nc1nc2ccc(-c3ocnc3-c3ccccc3)cc2s1] |

TABLE 1-continued

Inhibitors of Mapk14 activity

| name | Chemical name or structure |
|------|----------------------------|

IC50 p38α = 3.1 nM

TABLE 1-continued
Inhibitors of Mapk14 activity
| name | Chemical name or structure |
|---|---|
| | 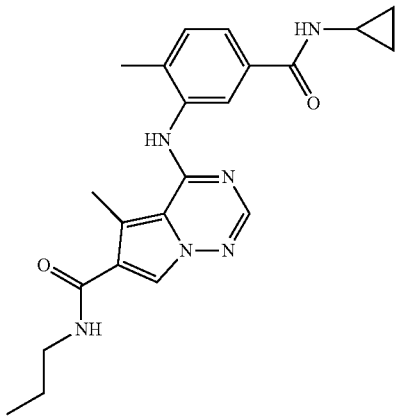 [SMILES: CCCNC(=O)c1cn2ncnc(Nc3cc(C(=O)NC4CC4)ccc3C)c2c1C] |
| | 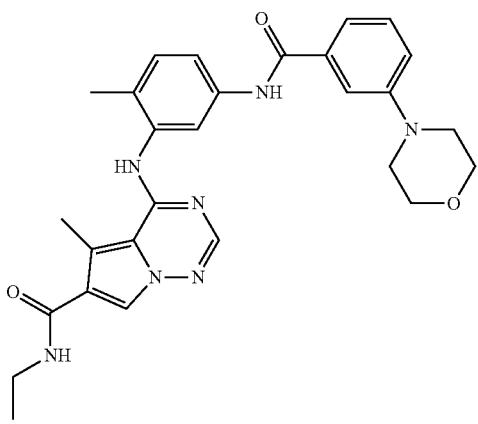 [SMILES: CCNC(=O)c1cn2ncnc(Nc3cc(NC(=O)c4cccc(N5CCOCC5)c4)ccc3C)c2c1C] |
| | 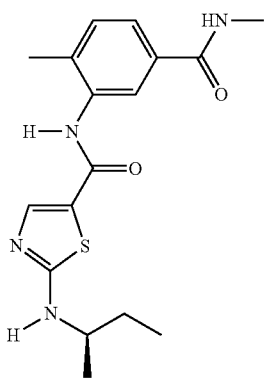 [SMILES: CC[C@@H](C)Nc1ncc(C(=O)Nc2cc(C(=O)NC)ccc2C)s1] |

173 174
TABLE 1-continued
Inhibitors of Mapk14 activity
| name | Chemical name or structure |
| --- | --- |
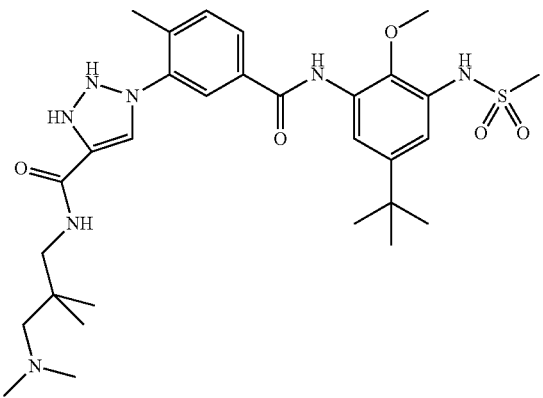
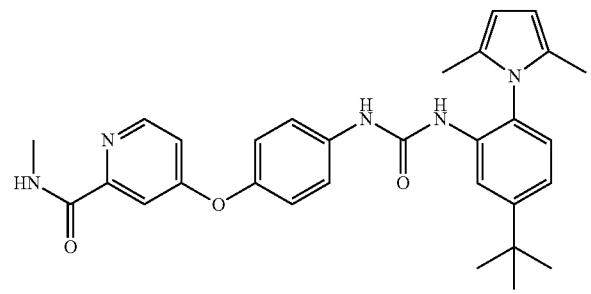
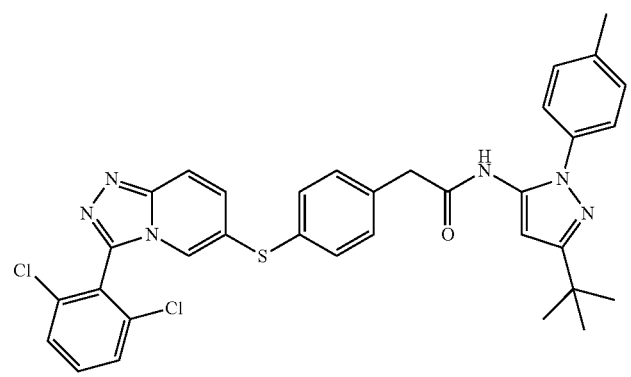
IC50 p38α < 10 nM TABLE 1-continued
Inhibitors of Mapk14 activity
| name | Chemical name or structure |
|---|---|
| | 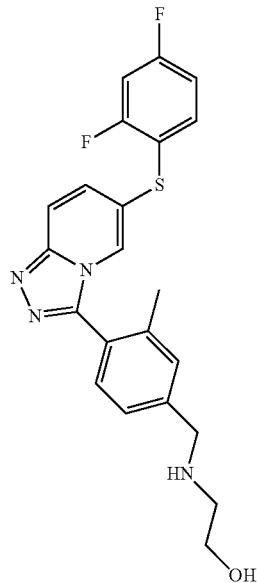 [SMILES: Cc1cc(CNCCO)ccc1-c1nnc2ccc(Sc3ccc(F)cc3F)cn12] |
| | 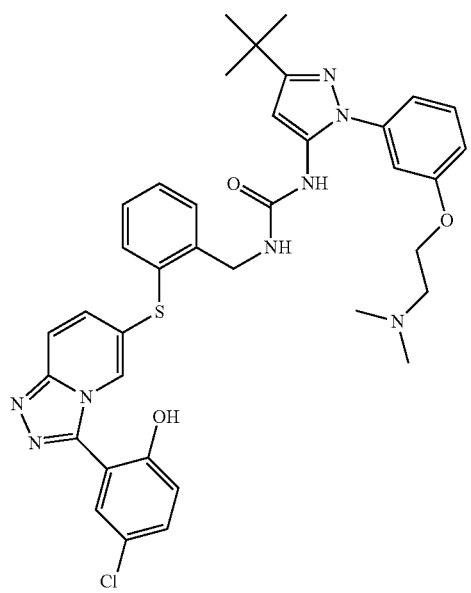 [SMILES: CN(C)CCOc1cccc(-n2nc(C(C)(C)C)cc2NC(=O)NCc2ccccc2Sc2ccc3nnc(-c4cc(Cl)ccc4O)n3c2)c1] |

TABLE 1-continued
Inhibitors of Mapk14 activity
| name | Chemical name or structure |
|------|----------------------------|
|      | 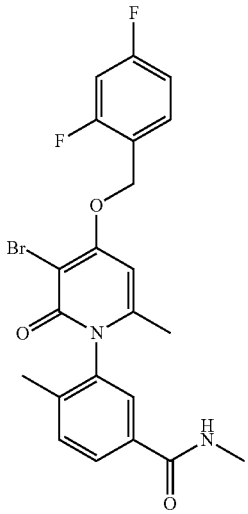 [SMILES: CNC(=O)c1ccc(C)c(-n2c(C)cc(OCc3ccc(F)cc3F)c(Br)c2=O)c1] |
|      | 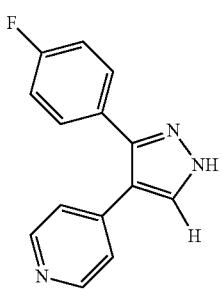 [SMILES: Fc1ccc(-c2n[nH]cc2-c2ccncc2)cc1] |
|      | 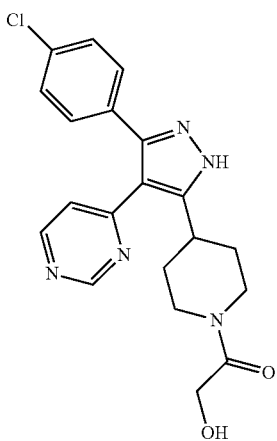 [SMILES: O=C(CO)N1CCC(c2[nH]nc(-c3ccc(Cl)cc3)c2-c2ccncn2)CC1] |

TABLE 1-continued
Inhibitors of Mapk14 activity
| name | Chemical name or structure |
|---|---|
| | 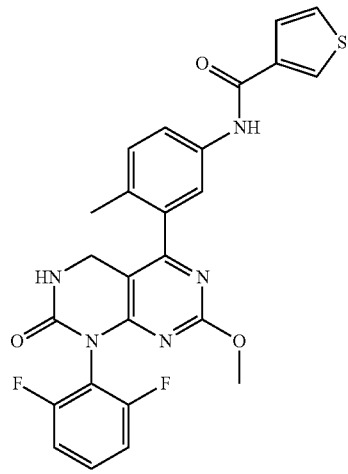 [SMILES: COc1nc(-c2cc(NC(=O)c3ccsc3)ccc2C)c2c(n1)N(c1c(F)cccc1F)C(=O)NC2] |
| | 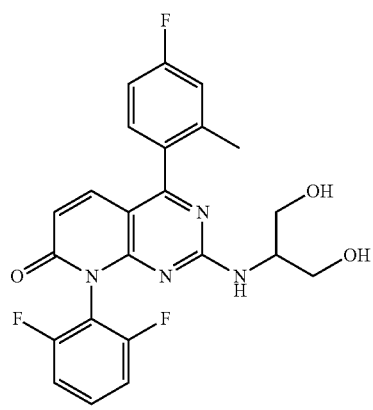 [SMILES: Cc1cc(F)ccc1-c1nc(NC(CO)CO)nc2c1ccc(=O)n2-c1c(F)cccc1F] |
| | 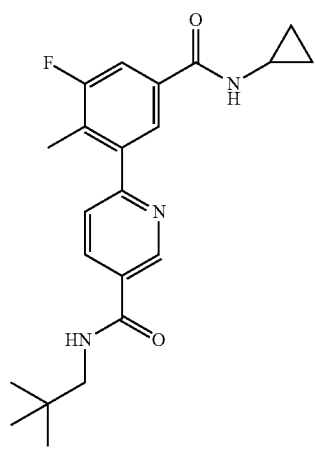 [SMILES: Cc1c(F)cc(C(=O)NC2CC2)cc1-c1ccc(C(=O)NCC(C)(C)C)cn1] |

TABLE 1-continued

Inhibitors of Mapk14 activity

| name | Chemical name or structure |
|---|---|

TABLE 1-continued
Inhibitors of Mapk14 activity
| name | Chemical name or structure |
|---|---|
| | 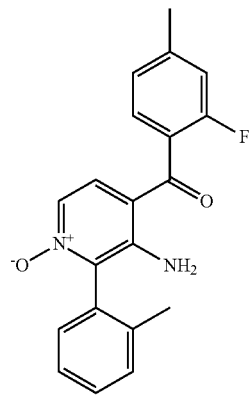<br>IC50 p38α = 21 nM |
| | 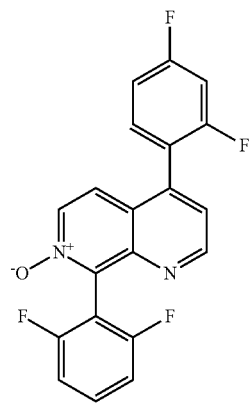 |
| | 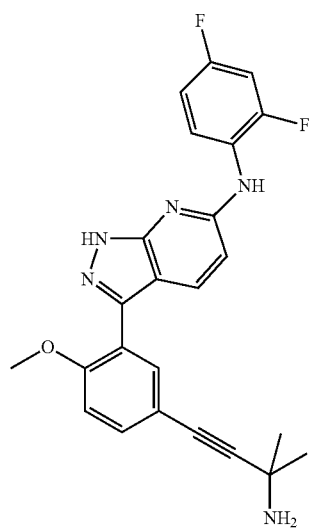 [SMILES: COc1ccc(C#CC(C)(C)N)cc1-c1n[nH]c2nc(Nc3ccc(F)cc3F)ccc12] |

TABLE 1-continued
Inhibitors of Mapk14 activity
| name | Chemical name or structure |
|---|---|
| | 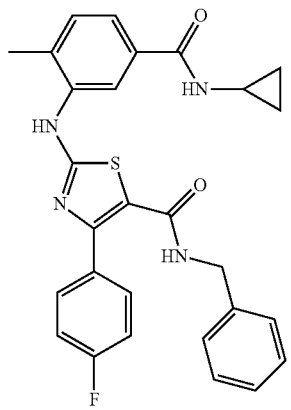 [SMILES: Cc1ccc(C(=O)NC2CC2)cc1Nc1nc(-c2ccc(F)cc2)c(C(=O)NCc2ccccc2)s1] |
| | 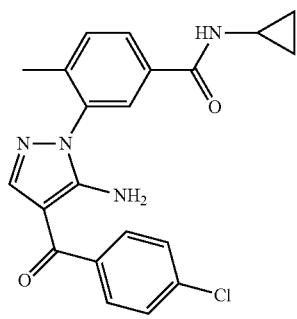 [SMILES: Cc1ccc(C(=O)NC2CC2)cc1-n1ncc(C(=O)c2ccc(Cl)cc2)c1N] |
| | 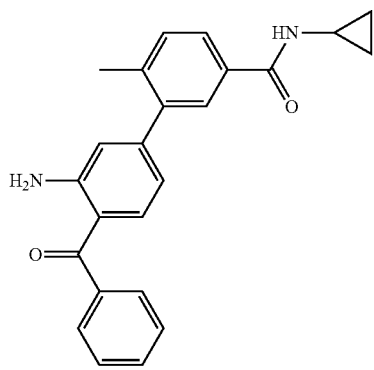 [SMILES: Cc1ccc(C(=O)NC2CC2)cc1-c1ccc(C(=O)c2ccccc2)c(N)c1] |
| | 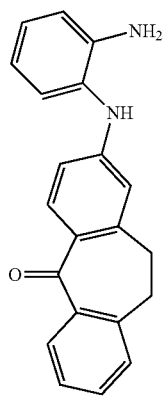 [SMILES: Nc1ccccc1Nc1ccc2c(c1)CCc1ccccc1C2=O] |

187
188
TABLE 1-continued
Inhibitors of Mapk14 activity
| name | Chemical name or structure |
|------|----------------------------|
|      | 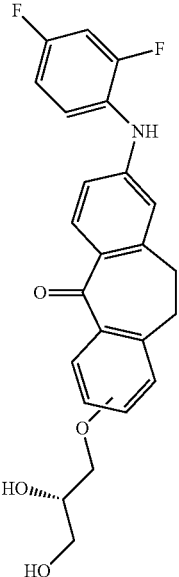       |
|      | 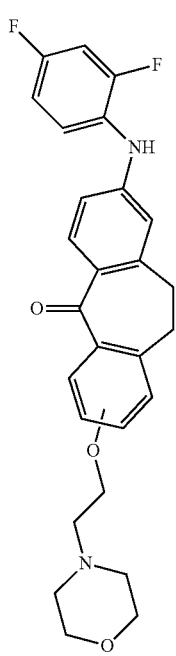       |

TABLE 1-continued

Inhibitors of Mapk14 activity

| name | Chemical name or structure |
|---|---|

TABLE 1-continued

Inhibitors of Mapk14 activity

| name | Chemical name or structure |
|---|---|
| BMS-582949 | |
| Skepinone-L | 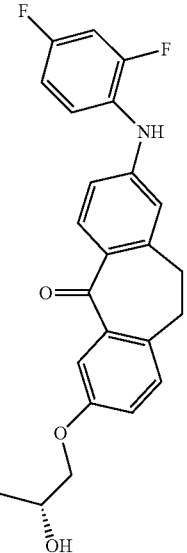<br>IC50 = 25 nM |

Unless otherwise defined, substituents R1 to R14 can be selected independently from the group comprising $CH_3$, $CH_2CH_3$, $CH_2CH_3CH_3$, $CH_2(CH_2)_2CH_3$, $CH_2$=$CH_2$, H, F, Cl, Br, I, $SO_2$, $CF_3$, $N_3$, OH, $NH_2$, =O, $N(CH_3)_2$, OMe, OEt, $SO_2Me$. In Table 1, IC50 values are for Mapk14.

In the above Table, references to tradenames, trivial names and especially to publication number of patents or patent applications include the subject-matter of such references and publications into the present application, especially in respect of characterizations and methods for synthesis of the compounds.

It was found in in vitro assays using cultivated liver cancer cells of both murine and human origin, respectively, that the efficacy of Sorafenib against liver cancer cells was increased in the presence of an inhibitor of Mapk14 activity. As examples for inhibitors of Mapk14 activity, BIRB-796, SB 202190, or SX 011 were used, which are kinase inhibitors that act upon and/or are specific for Mapk14 protein.

DETAILED DESCRIPTION OF THE INVENTION

Figure 2:
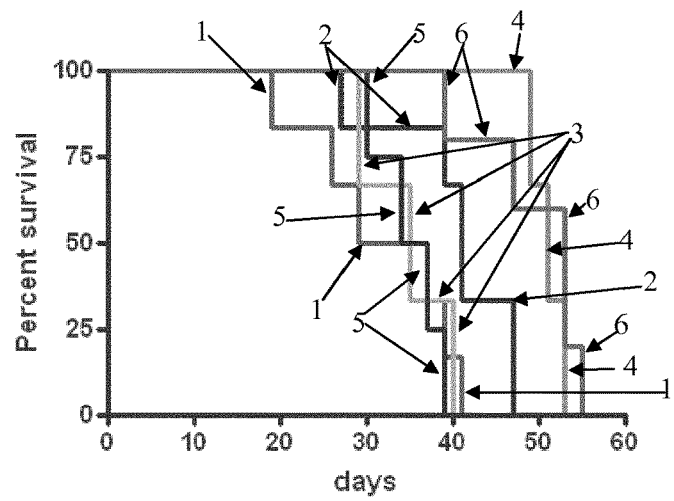
Figure 3:
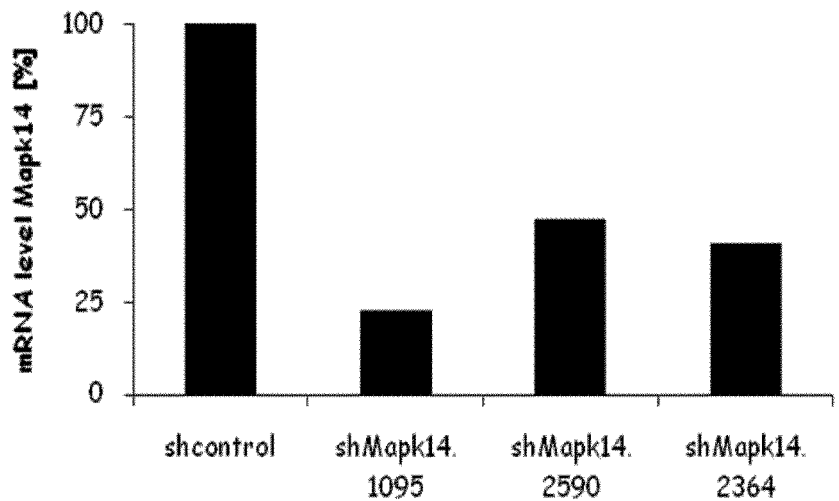
Figure 4:
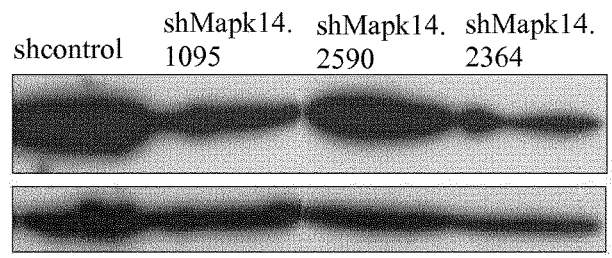
Figure 5:
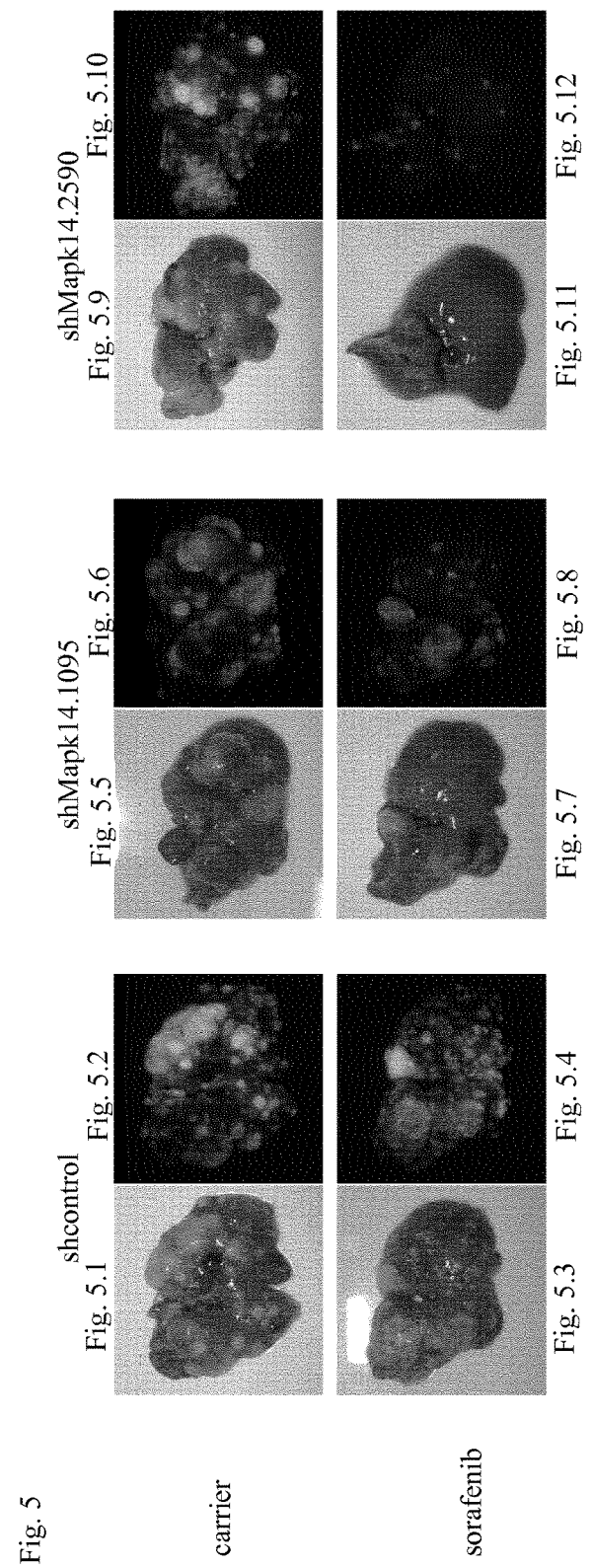
Figure 6:
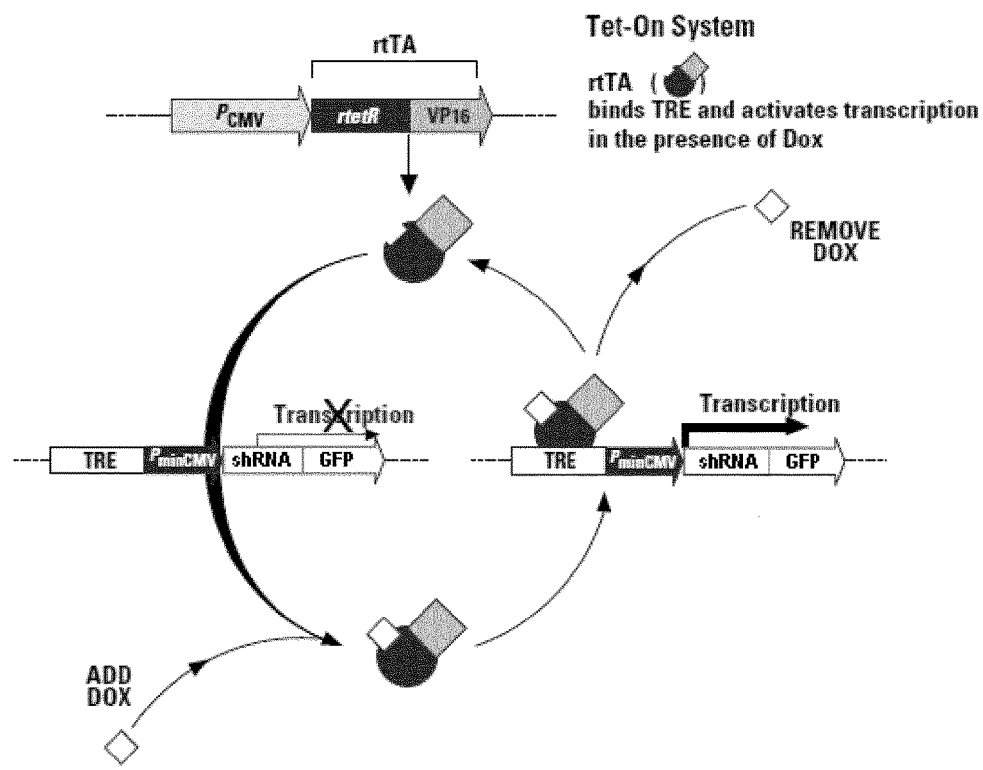

The invention is now described by way of examples with reference to the figures, wherein FIG. 1 schematically shows the constructs used for genetically manipulating mice for generation of liver carcinomas with concurrent expression of shRNAs which can be non-specific or specific for the mRNA encoding Mapk14, FIG. 2 shows the survival rates of mice expressing different shRNA molecules with and without administration of Sorafenib, FIG. 3 shows the detected levels of mRNA specific for Mapk14 with expression of shRNAs which are non-specific or specific for the mRNA encoding Mapk14, FIG. 4 shows a Western blot with specific detection for Mapk14 protein levels from cells expressing shRNA with or without specificity for Mapk14 mRNA, and with detection for α-tubulin as a loading control, FIG. 5 shows micrographs and GFP images of explanted mouse livers with and without administration of Sorafenib and expression of shRNAs specific for Mapk14 mRNA and controls, FIG. 6 schematically depicts the mechanism of the doxycycline dependent transcription of shRNAs and the GFP marker gene.

Figure 7:
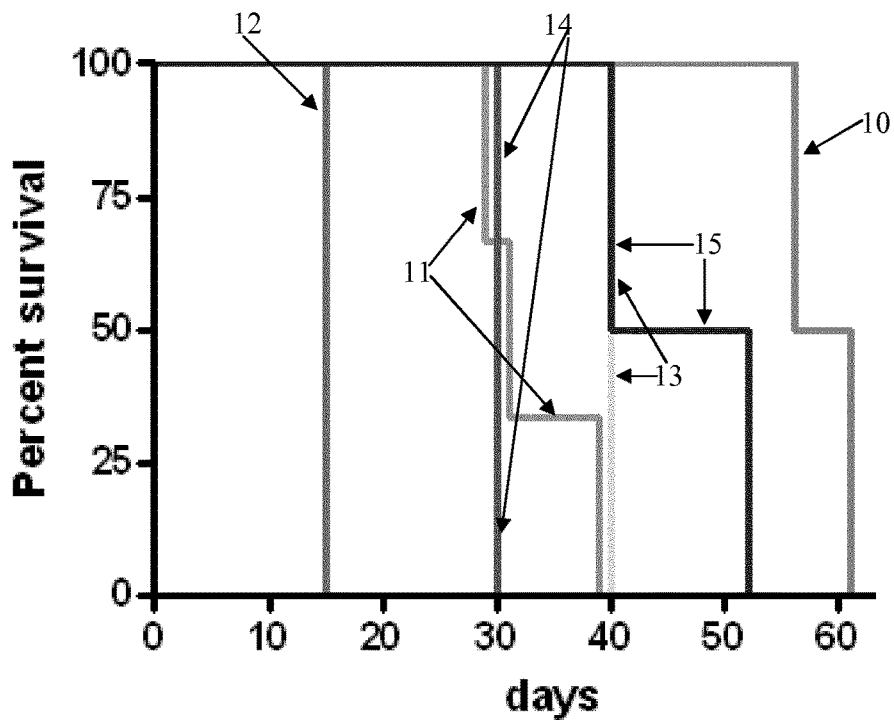

FIG. 7 shows the survival rates of mice treated with Sorafenib or a control compound (carrier) in the presence of the shRNA specific for the mRNA encoding Mapk14, (which transcription was activated 5 days after tumor development) and in the absence of the shRNA specific for the mRNA encoding Mapk14, as well as control shRNAs.

Figure 8:
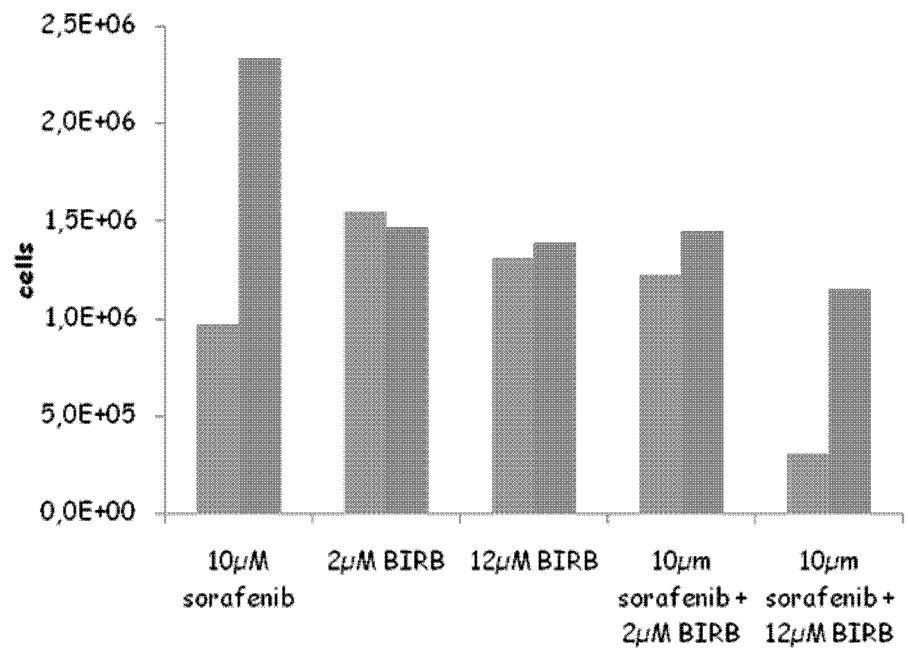
Figure 9:
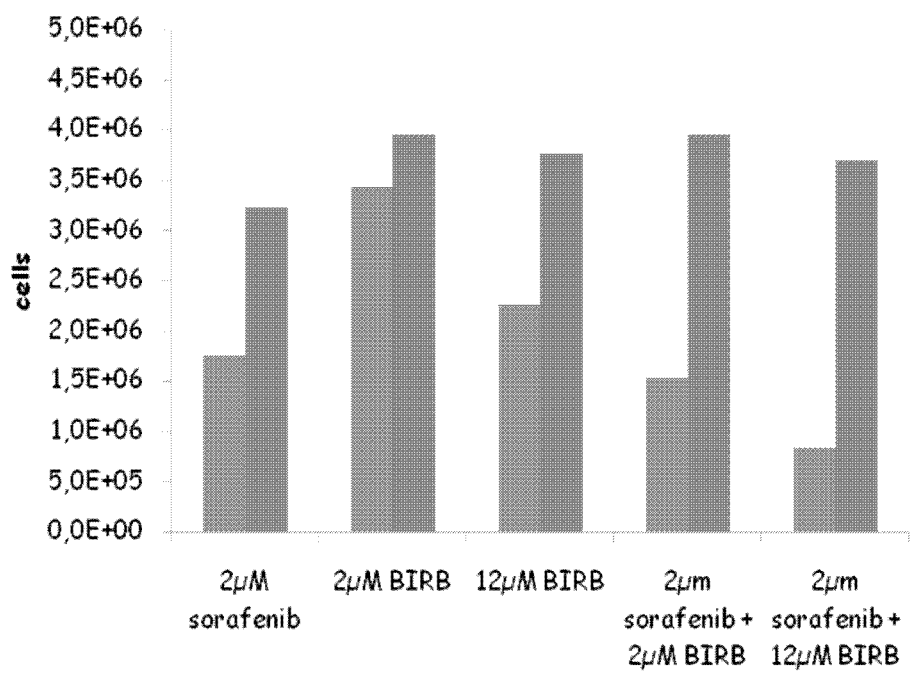
Figure 10:
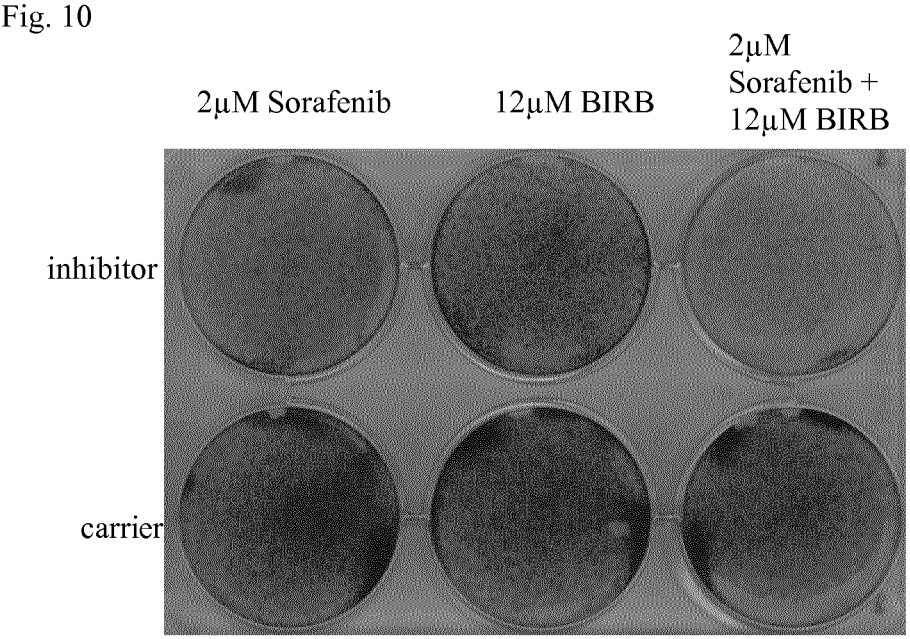
Figure 11:
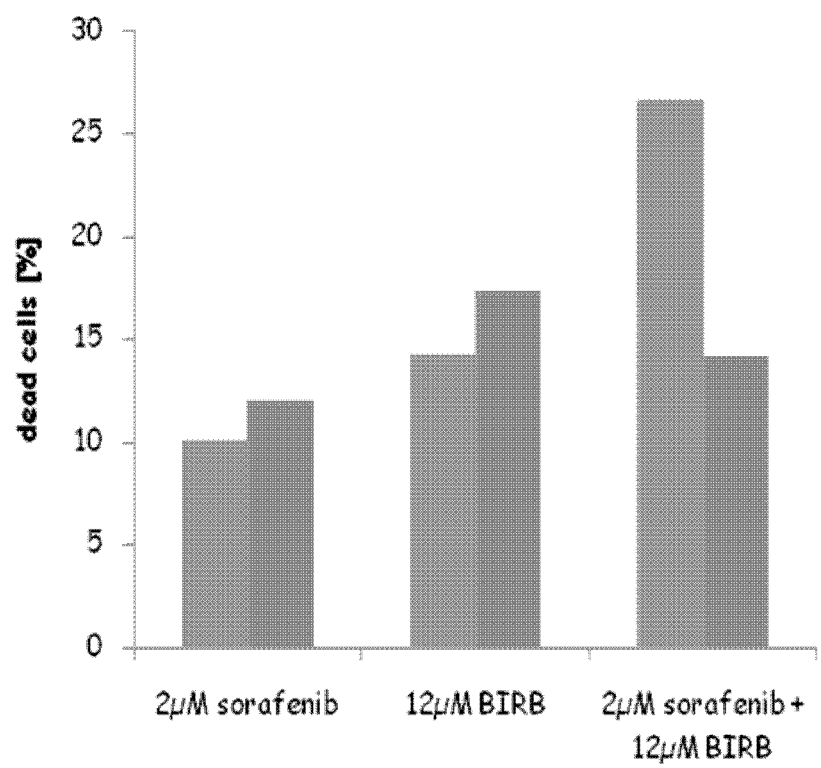
Figure 12:
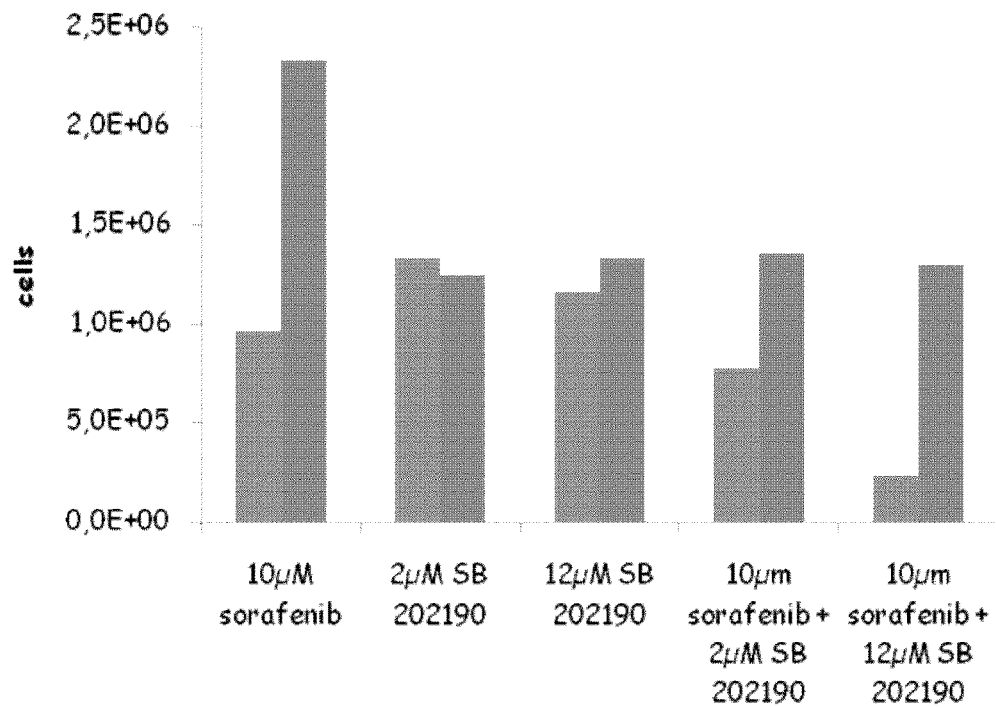
Figure 13:
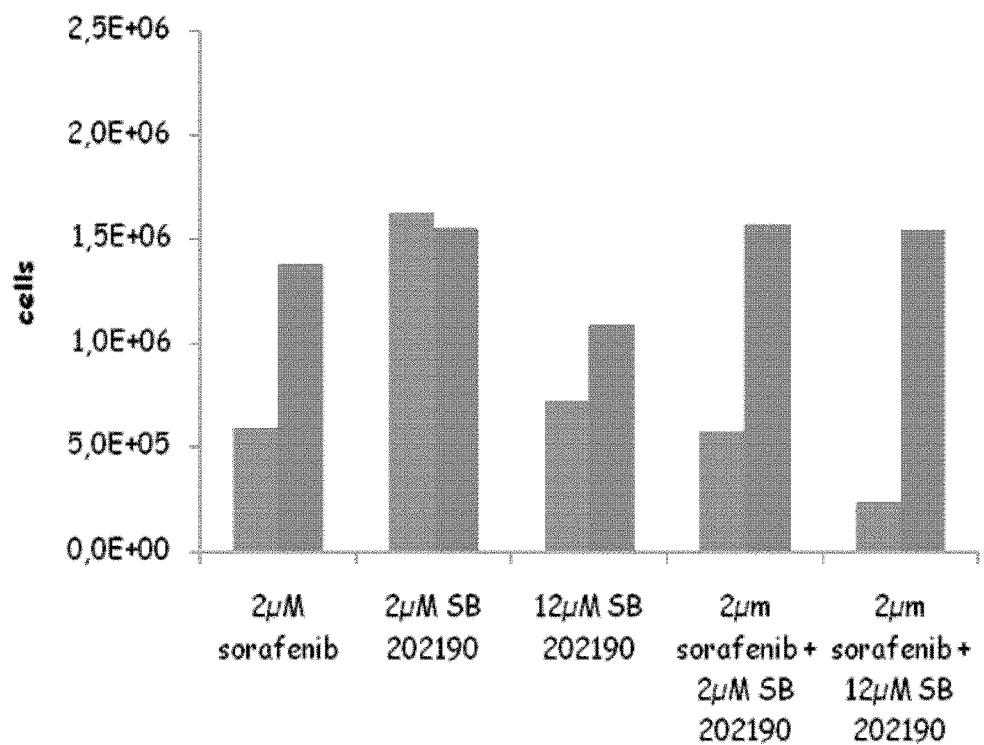
Figure 14:
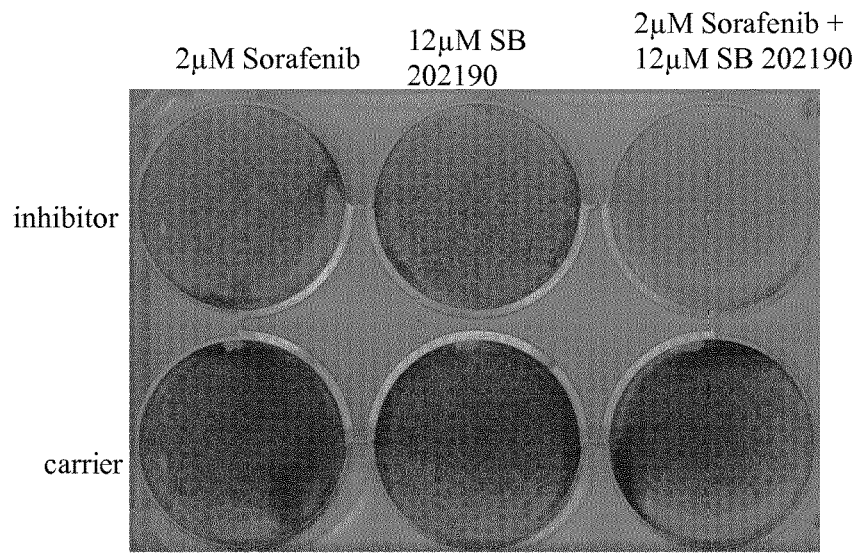
Figure 15:
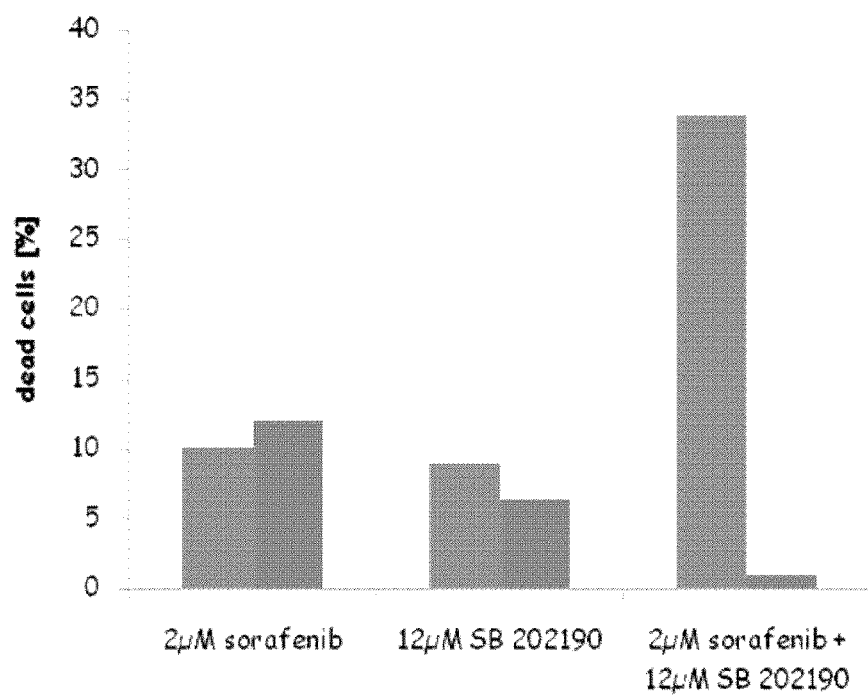
Figure 16:
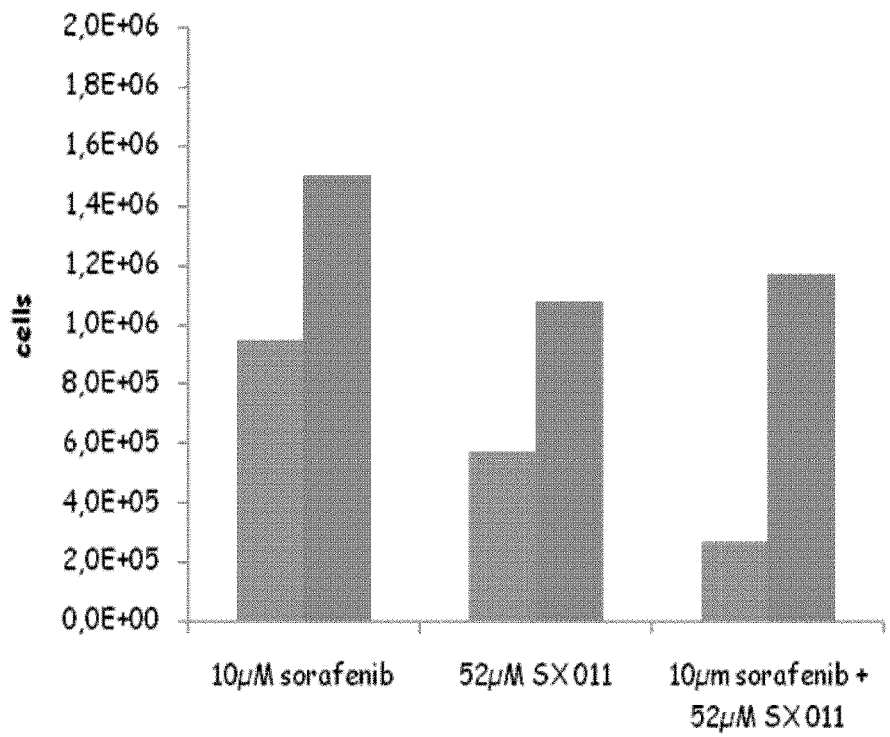
Figure 17:
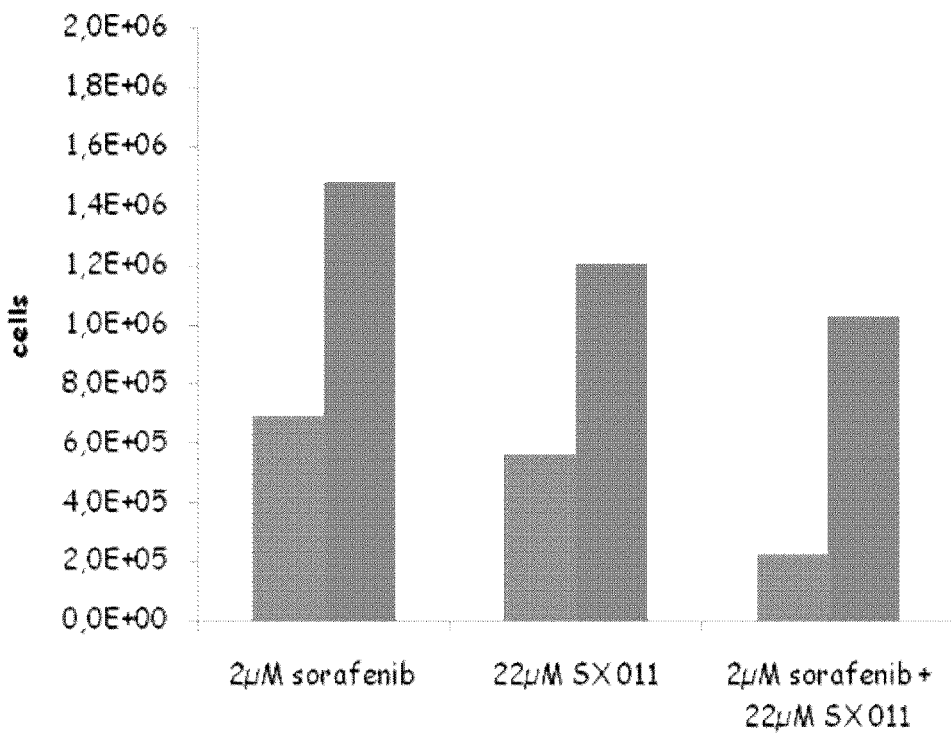

FIG. 8 shows the number of cells (as an indicator of proliferative activity) in an in vitro assay in which murine liver cancer cells were treated with Sorafenib in combination with the Mapk14 inhibitor BIRB-796, FIG. 9 shows the number of cells (as an indicator of proliferative activity) in an in vitro assay, in which a human liver cancer cell line was treated with Sorafenib in combination with the inhibitor of Mapk14 BIRB-796, FIG. 10 shows a picture of cell staining (cell density as an indicator of proliferative activity) (crystal violet assay) of a human liver cancer cell line after treatment of Sorafenib in combination with the Mapk14-specific inhibitor BIRB-796, FIG. 11 shows the quantification of the number of dead cells (human liver cancer cell line) after treatment with Sorafenib in combination with the Mapk14-specific inhibitor BIRB-796 and controls, respectively, FIG. 12 shows the number of cells in an in vitro assay in which a murine hepatocyte cancer cell line was treated with Sorafenib in combination with the Mapk14 inhibitor SB202190, FIG. 13 shows the number of cells in an in vitro assay, in which a human liver cancer cell line was treated with Sorafenib in combination with the inhibitor of Mapk14 SB202190, FIG. 14 shows a picture of cell staining (cell density as a marker for proliferative activity) of a human liver cancer cell line after treatment of Sorafenib in combination with the Mapk14-specific inhibitor SB202190, FIG. 15 shows the quantification of the number of dead cells (human liver cancer cell line) after treatment with Sorafenib in combination with the Mapk14-specific inhibitor SB202190 and controls, respectively, FIG. 16 shows the number of cells in an in vitro assay in which a murine liver cancer cell line was treated with Sorafenib in combination with the Mapk14 inhibitor SX011, and FIG. 17 shows the number of cells in an in vitro assay, in which a human liver cancer cell line was treated with Sorafenib in combination with the inhibitor of Mapk14 SX011.

EXAMPLE 1

Treatment of Liver Cancer In Vivo

As a representative of a human patient having liver cancer, a genetically manipulated mouse model (p19$^{Arf-/-}$) was generated, in which liver cancers were induced by a constitutive expression of the oncogenic NrasG12V mutant.

The nucleic acid construct for generating liver carcinomas is schematically shown in FIG. 1, containing an expression cassette, wherein the coding sequence for NrasG12V is arranged between a 5' promoter sequence and a 3' polyadenylation site, which expression cassette is flanked by two inverted repeat elements (IR). For intrahepatic delivery of the expression cassette, this nucleic acid construct was administered in combination with a nucleic acid construct containing an expression cassette for the transposase sleeping beauty 13 (SB 13) under the control of the constitutive phosphoglycerate kinase promoter (PGK). The mouse model receiving both nucleic acid constructs shown in FIG. 1 was p19$^{Arf-/-}$, providing the genetic background sufficient for constitutive generation of murine liver cancer. Nucleic acid constructs were introduced into experimental mice using hydrodynamic tail vein injection.

Mice that were genetically conditioned to develop liver cancer were treated with a pharmaceutical composition containing Sorafenib in a carrier, and carrier alone as a control.

The expression cassette in addition to the coding sequence for Nras12V contains the coding sequence for a short hairpin RNA as an example for an siRNA/shRNA. As an shRNA, a non-specific shRNA (shcontrol) was used, an shRNA specific for the murine mRNA encoding murine Mapk14 (shMapk14.1095), and an alternative shRNA specific for the murine mRNA encoding Mapk14 (shMapk14.2590). For each mouse model having one of the nucleic acid constructs, mice were mock-treated with carrier, or with Sorafenib alone.

The survival curves are shown in FIG. 2. A liver cancer patient without a Mapk14 inhibitor is represented by the non-specific shRNA (1, shcontrol+carrier) and with the known treatment of Sorafenib (2, shcontrol+Sorafenib) according to the mouse model has an increased survival rate, whereas both mouse models in which the Mapk14 activity is inhibited by the shRNA specific for the mRNA encoding Mapk14 in combination with Sorafenib (4, shMapk14.1095+Sorafenib, and 6, shMapk14.2590+Sorafenib) have a significantly increased survival rate. In contrast, the inactivation of Mapk14 alone by an shRNA, i.e. without treatment by administration of Sorafenib (3, shMapk14.1095+carrier and 5, shMapk14.2590+carrier) have a survival rate essentially corresponding to the survival rate of mouse models without inactivation of Mapk14 (1, 3, 5).

FIG. 3 shows the levels of mRNA encoding Mapk14 in relation (%) to the non-specific control shRNA (shcontrol). It can be seen that the expression of each of shMapk14.1095 (SEQ ID NO: 1370) and shMapk14.2590 (SEQ ID NO: 1371) and of shMapk14.2364, which hybridize to the mRNA encoding Mapk14 results in a reduction of the mRNA encoding Mapk14 in the liver tissue.

FIG. 4 shows Western blot analyses of murine liver cancer cells with specific detection of Mapk14 and α-tubulin as a loading control. This analysis shows that the expression level of Mapk14 is significantly reduced by expression of shRNA specific for the mRNA encoding Mapk14, exemplified by shMapk14.1095, shMapk14.2590, and shMapk14.2364, whereas there is a drastically higher level of Mapk14 expression in the presence of shRNA (shcontrol) expression.

FIG. 5 shows photographs of livers explanted from the mouse model and the respective GFP—imaging of explanted mouse livers, confirming visually that in mouse models receiving no Sorafenib (top row, FIGS. 5.1, 5.2, 5.5, 5.6, 5.9, and 5.10) (carrier), the expression of a non-specific shRNA (shcontrol, FIGS. 5.1, 5.2) or of an shRNA inactivating Mapk14 (shMapk14.1095, shMapk14.2590, FIGS. 5.5, 5.6, 5.9, and 5.10) essentially do not reduce the development of liver cancer.

In a further experiment it was observed that in further control mice which did not express an shRNA, a similar tumor development and a similar survival rate was found as for the mice expressing the non-specific shRNA (shcontrol).

The lower row of pictures of FIG. 5 (FIGS. 5.3, 5.4, 5.7, 5.8, 5.11, and 5.12) shows that the inactivation of Mapk14, in this assay obtained in vivo by expression of an shRNA specific for the mRNA encoding Mapk14 (5.7, 5.8, 5.11, and 5.12) in the presence of treatment with Sorafenib drastically reduces the occurrence of liver cancer both in relation to the treatment with Sorafenib alone (FIGS. 5.3 and 5.4) and in relation to expression of an inhibitory shRNA alone (FIGS. 5.5, 5.6, 5.9, and 5.10).

The GFP imaging correlates with expression of NrasG12V positive tumors. Decreased GFP activity is observed for shRNAs shMapk14.1095 and shMapk14.2590 in the presence of Sorafenib, indicating reduction of cancer cells that were induced by the expression of Nras.

EXAMPLE 2

Treatment of Liver Cancer

Again, mouse models were used for representing human liver cancer patients in treatment using Sorafenib in combination with an agent inhibiting the activity of Mapk14. As an example for a pharmaceutical agent for the inactivation of the activity of Mapk14, an shRNA (shMapk14.1095) specific for the murine mRNA encoding Mapk14 was used. The shRNA was provided by controlled expression using an expression cassette which is under the control of a tetracycline response element (TRE) of the otherwise constitutive viral promoter ($P_{minCMV}$). The expression cassette contains the coding sequence for a shRNA molecule and the coding sequence of a GFP marker gene. The nucleic acid construct containing the expression cassette for the shRNA molecule and the coding sequence of a GFP marker gene under the control of the Tet-inducible promoter also contains a constitutive expression cassette for rtTA (rtetRVP16), which in the presence of Doxycycline (DOX) binds to the TRE and activates the promoter of the expression cassette encoding a fusion of shRNA and GFP.

FIG. 6 schematically shows the nucleic acid constructs and the mechanism for inducing transcription of shRNA and GFP encoding sequence.

Generally, the nucleic acid construct of FIG. 6 is introduced into experimental mice via retroviral infection of cancer cells which after selection are injected into the liver of wildtype mice. The injected mice then develop liver carcinomas in which Mapk14 can be conditionally inactivated by inducing transcription of the shRNA by addition of DOX.

FIG. 7 shows the result of an experiment using the expression of an shRNA specific for the mRNA encoding murine Mapk14, namely shMapk14.1095, or a non-specific shRNA (shcontrol). The administration of DOX induces inactivation of Mapk14 by inducing transcription of the shRNA and GFP. The administration of DOX in combination with Sorafenib significantly increased survival rates (10, shMapk14.1095+DOX+Sorafenib), whereas in the absence of the inactivation of Mapk14, represented by the lack of induction of shMapk14 in the absence of DOX (14, shMapk14.1095−DOX+Sorafenib) or in the presence of a non-specific shRNA (12, shcontrol+DOX+Sorafenib) showed a lower survival rate as expected for treatment by Sorafenib alone. For control, the absence of a specific inhibitory shRNA and without Sorafenib (15, shMapk14.1095−DOX−Sorafenib), in the absence of non-specific shRNA and without Sorafenib (13, shcontrol−DOX−Sorafenib), and with presence of Mapk14 specific shRNA without Sorafenib but carrier (11, shMapk14.1095+DOX+carrier) were tested.

EXAMPLE 3

Inactivation of Mapk14 by a Specific Kinase Inhibitor Increases the Efficacy of Sorafenib Against Liver Cancer Cell Lines As an example for a medicament containing Sorafenib in combination with an inhibitor specific for Mapk14 kinase, BIRB-796, SB 202190 and SX 001 were tested in an in vitro assay. These in vitro experiments show the increased efficacy of Sorafenib when administered in combination with an inhibitor of Mapk14 kinase protein on the example of cultivated murine and human liver cancer cell lines.

In the assay, murine liver cancer cells (Nras arf−/−) were cultivated. Cultivated cells were treated with 10 µM Sorafenib, 2 µM BIRB, 12 µM BIRB and with a combination of 10 µM Sorafenib+2 µM BIRB, or a combination of 10 µM Sorafenib+12 µM BIRB. For each of these assays, a parallel assay was made, replacing Sorafenib or Mapk14 inhibitors by formulation agents without pharmaceutical active agent (carrier).

FIG. 8 shows the results of the viable cell count after two days of treatment of the murine cancer cells and FIG. 9 shows the viable cell count after 7 days of treatment of the cultivated human liver cancer cell line (Hep3B) with the combinations of 2 µM Sorafenib, 2 µM BIRB, 12 µM BIRB, a combination of 2 µM Sorafenib+2 µM BIRB, or a combination of 2 µM Sorafenib+12 µM BIRB, respectively, in the left columns, whereas samples without pharmaceutical active agent (carrier) are shown as right hand columns. These results show that the activity of Sorafenib against liver cancer cells can be reproduced in vitro with cultivated murine and human liver cancer cells, respectively. In detail, the presence of 10 µM or 2 µM Sorafenib as the only pharmaceutical active agent shows a decrease of viable cancer cells after two and seven days, respectively, whereas in murine cells, the inhibitor BIRB-796 only has no significant influence on cultivated murine liver cancer cells, whereas BIRB-796 alone shows a reduction of viable human cancer cells. In murine liver cancer cells, and even more pronounced in human liver cancer cells, the combination of Sorafenib with the inhibitor BIRB-796 shows a marked increase in the efficacy over Sorafenib alone, and the combination of 12 µM BIRB-796 with 2 µM Sorafenib results in a significant decrease in viable cancer cells compared to the reduction of cancer cells by Sorafenib alone.

FIG. 10 shows crystal violet staining of cultivated human liver cancer cells which are cultivated and treated for 7 days with 2 µM Sorafenib, 12 µM BIRB-796, or a combination of 2 µM Sorafenib+12 µM BIRB-796 (upper row), controls without kinase inhibitor are shown in the lower row (carrier). This view of the culture plates makes it evident that the combination of Sorafenib with an inhibitor for Mapk14, represented by BIRB-796, increases the efficacy of Sorafenib.

The dead cell count of FIG. 11, using trypane blue staining of the cultivated human liver cancer cells (Hep3B) shows that the increase in dead cells in the presence of an inhibitor (left hand columns) was more prominent for the combination of Sorafenib with BIRB-796 over Sorafenib or BIRB-796 alone, and over the control (carrier, right hand columns) without a kinase inhibitor.

Similar to the assay for BIRB-796, SB 202190 was tested in an in vitro assay of the murine liver cancer cells (Nras Arf−/−) and the human liver cancer cell line (Hep3B).

FIG. 12 shows the results of the viable cell count after two days of treatment of the murine cancer cells and FIG. 13 shows the viable cell count after 7 days of treatment of the cultivated human liver cancer cell line (Hep3B) with the combinations of 2 µM Sorafenib, 2 µM SB202190, 12 µM SB202190, a combination of 2 µM Sorafenib+2 µM SB202190, or a combination of 2 µM Sorafenib+12 µM SB202190, respectively, in the left columns, whereas samples without pharmaceutical active agent (carrier) are shown as right hand columns.

These results confirm that the activity of Sorafenib against liver cancer cells can be reproduced in vitro with cultivated murine and human cancer cell lines respectively. Further, in murine cancer cells, and even more pronounced in human cancer cells, the combination of Sorafenib with the inhibitor SB202190 shows a marked increase in the efficacy over Sorafenib alone, and the combination of 12 µM SB202190 with 2 µM Sorafenib results in a significant decrease in viable cancer cells compared to the reduction of cancer cells by Sorafenib alone.

FIG. 14 shows the crystal violet staining of cultivated human liver cancer cells which are cultivated and treated for 7 days with 2 µM Sorafenib, 12 µM SB202190, or a combination of 2 µM Sorafenib+12 µM SB202190 (upper row), controls without kinase inhibitor are shown in the lower row (carrier). This view of the culture plates makes it evident that the combination of Sorafenib with an inhibitor for Mapk14, represented by SB202190, increases the efficacy of Sorafenib.

The dead cell count shown in FIG. 15 (left hand columns indicate counts in presence of inhibitor, right hand columns are control with carrier only) supports the finding that the combination of the Mapk14 inhibitor SB202190 with Sorafenib is significantly more effective than Sorafenib or SB202190 alone.

FIG. 16 shows the results of the viable cell counts after two days of treatment of the murine cancer cells, and FIG. 17 shows the viable cell count after 7 days of treatment of the cultivated human liver cancer cell line (Hep3B) with the combinations of 10 µM or 2 µM Sorafenib, 52 µM or 22 µM SX 011, and a combination of 10 or 2 µM Sorafenib+52 or 22 µM SX 011 respectively, in the left hand columns, whereas samples without pharmaceutical active agent (carrier) are shown as right hand columns.

These results confirm that the activity of Sorafenib against liver cancer cells can be reproduced in vitro with cultivated murine and human liver cancer cells, respectively. Further, in murine cancer cells, and even more pronounced in human cancer cells, the combination of Sorafenib with the inhibitor SX 011 shows a marked increase in the efficacy over Sorafenib alone, and the combination of SX 011 with Sorafenib results in a significant decrease in viable cancer cells compared to the reduction of cancer cells by Sorafenib alone.

SEQUENCE LISTING (1371 sequences)

SEQ ID NO: 1 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuugcauugaacauauuccua

SEQ ID NO: 2 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuguaggaaaucacacgag

SEQ ID NO: 3 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaucaucaggaucguggua

SEQ ID NO: 4 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaacacagaauagcacuag

SEQ ID NO: 5 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggagcauccacaaccuccug

SEQ ID NO: 6 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauucucuuaucugagucca

SEQ ID NO: 7 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaguuuguucauauugucuua

SEQ ID NO: 8 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaacuugagaaacucacuaa

SEQ ID NO: 9 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcauugaacauauuccuaa

SEQ ID NO: 10 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucuguaggaaaucacacga

SEQ ID NO: 11 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugucugacauccuauacggc

SEQ ID NO: 12 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuauacuuucuuauuacacaa

SEQ ID NO: 13 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuguucauauugucuuacccu

SEQ ID NO: 14 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugagaaauggaaacaccuug

SEQ ID NO: 15 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacugucaagaucugagaa

SEQ ID NO: 16 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaaguaaccgcaguucucug

SEQ ID NO: 17 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaggaguaguauuaagaucug

SEQ ID NO: 18 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaagaaaccucugcaccaa

SEQ ID NO: 19 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaggaacugaacauggucau

SEQ ID NO: 20 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugaauuccuccagagaccuu

SEQ ID NO: 21 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaagguucacuuuccuugaa

SEQ ID NO: 22 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacauucgcaaaguucaucuu

SEQ ID NO: 23 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaagcuucugacauuucacaa

SEQ ID NO: 24 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaacuugagaaacucacua

SEQ ID NO: 25 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaccaaauaucaacugucug

SEQ ID NO: 26 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucuuagcaggcuacaccaa

SEQ ID NO: 27 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagaccucggagaauuuggua

SEQ ID NO: 28 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugaacugcaauaaaggagau

SEQ ID NO: 29 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaagcaucuucuccagcaa

SEQ ID NO: 30 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaacuaucuacacuuucuucu

SEQ ID NO: 31 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauauggucuguaccaggaa

SEQ ID NO: 32 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaucacugcacugauugag

SEQ ID NO: 33 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugagaaccauacuaagcaa

SEQ ID NO: 34 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuacacuuucuucucuccuu

SEQ ID NO: 35 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuuagcauuaguuauuggg

SEQ ID NO: 36 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuucguucauuugcucuuu

SEQ ID NO: 37 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuacuuuaaagguucacuuu

SEQ ID NO: 38 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauacuucguucauuugcuc

SEQ ID NO: 39 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucacagcuagauuacuaggu

SEQ ID NO: 40 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuugcuccaguugacucag

SEQ ID NO: 41 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugaauaauauuuggagaguu

SEQ ID NO: 42 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguucaucaucaggaucgug

SEQ ID NO: 43 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaguaaccgcaguucucugu

SEQ ID NO: 44 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacacaucauugaauuccuc

SEQ ID NO: 45 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucaggucugaagcaaccag

SEQ ID NO: 46 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuugcucuuugcuuuacccau

SEQ ID NO: 47 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucacuuuccuugaaaggggg

SEQ ID NO: 48 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucagacgcauaaucugcug

SEQ ID NO: 49 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuuccagucaacagcucgg

SEQ ID NO: 50 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacauguaucacugcacugau

SEQ ID NO: 51 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacacuuucuucucuccuuuu

SEQ ID NO: 52 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaucuugcuguggauggug

SEQ ID NO: 53 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauauugucuuacccuccca

SEQ ID NO: 54 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccagucaacagcucggcca

SEQ ID NO: 55 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacauggucaucuguaagcuu

SEQ ID NO: 56 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucuuagcauuaguuauugg

SEQ ID NO: 57 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacuuuagaccucggagaa

SEQ ID NO: 58 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggucaucuguaagcuucug

SEQ ID NO: 59 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucacugcacugauugagaa

SEQ ID NO: 60 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauauacuuuagaccucggag

SEQ ID NO: 61 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguaguauuaagaucugucag

SEQ ID NO: 62 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guacaugacaucaagaaccug

SEQ ID NO: 63 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauguuuaaguaaccgcaguu

SEQ ID NO: 64 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacuuucuuauuacacaaa

SEQ ID NO: 65 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcacacacacuaacacgca

SEQ ID NO: 66 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaguuucaaauauacuguc

SEQ ID NO: 67 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauauuuggagaguucccgu

SEQ ID NO: 68 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuacaguuucaaauauacug

SEQ ID NO: 69 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucuauaaggaggucccug

SEQ ID NO: 70 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauaauaaacuugagaaacuc

SEQ ID NO: 71 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacaguuucaaauauacugu

SEQ ID NO: 72 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaacgcucgggcaccucccag

SEQ ID NO: 73 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuagcaggcuacaccaaacag

SEQ ID NO: 74 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucguucauuugcucuuugcuu

SEQ ID NO: 75 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucuguaagcuucugacau

SEQ ID NO: 76 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuacacuuucuucucuccu

SEQ ID NO: 77 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucgcgagaacagcucccgg

SEQ ID NO: 78 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaucaacugucugguugua

SEQ ID NO: 79 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauauacugucaagaucuga

SEQ ID NO: 80 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacacacuaacacgcacgca

SEQ ID NO: 81 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auugucugacauccuauacgg

SEQ ID NO: 82 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucgcaaaguucaucuucggc

SEQ ID NO: 83 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucuuguucagcuccugccg

SEQ ID NO: 84 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucauauguuuaaguaaccg

SEQ ID NO: 85 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auugagaaauggaaacaccuu

SEQ ID NO: 86 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguucuuccagucaacagcuc

SEQ ID NO: 87 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagcauuaguuauugggagug

SEQ ID NO: 88 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacacaggaaguacaugacau

SEQ ID NO: 89 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaguuuguucauauugucuu

SEQ ID NO: 90 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuagaguccaggcuuccagag

SEQ ID NO: 91 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucugaguccaauacaagcau

SEQ ID NO: 92 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauucucuuaucugaguccaa

SEQ ID NO: 93 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagacugaauauaguuucuu

SEQ ID NO: 94 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagacagacacacacaugcac

SEQ ID NO: 95 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuccagucaacagcucggc

SEQ ID NO: 96 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauaugaguccucauguagaa

SEQ ID NO: 97 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagcaggcuacaccaaacagg

SEQ ID NO: 98 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaagaucugucagacaagua

SEQ ID NO: 99 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauuuggagaguucccgug

SEQ ID NO: 100 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucgcaaaguucaucuucgg

SEQ ID NO: 101 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagagagcaggacaagcag

SEQ ID NO: 102 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugagaaacucacuaaauuug

SEQ ID NO: 103 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucugaguccaauacaagca

SEQ ID NO: 104 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacacagaauagcacuagggg

SEQ ID NO: 105 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucagagcaguauuucugua

SEQ ID NO: 106 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagaaauaaagaguacacagg

SEQ ID NO: 107 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugucagacaaguaugccag

SEQ ID NO: 108 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauaaacuugagaaacucac

SEQ ID NO: 109 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuauaaggaggucccugcuu

SEQ ID NO: 110 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaggcuccaguggucgcggu

SEQ ID NO: 111 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagauucugucacacagccaa

SEQ ID NO: 112 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaaauauaugaguccucaug

SEQ ID NO: 113 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaucaggaucgugguacug

SEQ ID NO: 114 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuaaguaaccgcaguucucu

SEQ ID NO: 115 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaugcucagaaaccgaagag

SEQ ID NO: 116 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagauaaggaacugaacaugg

SEQ ID NO: 117 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucugguuguaaugcaucca

SEQ ID NO: 118 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguauugucugacauccuau

SEQ ID NO: 119 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuaucuacacuuucuucucu

SEQ ID NO: 120 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagaauaacuuguuuccga

SEQ ID NO: 121 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuagaccucggagaauuuggu

SEQ ID NO: 122 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaauauuuggagaguucccg

SEQ ID NO: 123 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuugaacugcaauaaaggag

SEQ ID NO: 124 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcuccaguugacucagggg

SEQ ID NO: 125 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugauggacugaaauggucugg

SEQ ID NO: 126 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaucuucggcaucugaguc

SEQ ID NO: 127 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggaguacauguaucacugca

SEQ ID NO: 128 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuugcucuuugcuuuaccca

SEQ ID NO: 129 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuguucagcuccugccggu

SEQ ID NO: 130 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagucacugugaucauaguu

SEQ ID NO: 131 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacacucgaguguagauaag

SEQ ID NO: 132 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaagaguacacaggaagua

SEQ ID NO: 133 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccagagcaugcagccuccu

SEQ ID NO: 134 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacauccaccuguuccucuuu

SEQ ID NO: 135 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaggaaaucacacgagcau

SEQ ID NO: 136 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucagcugaggugacauggg

SEQ ID NO: 137 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcacacacacuaacacgcac

SEQ ID NO: 138 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuucagcagcugcagucuu

SEQ ID NO: 139 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuugguagauaaggaacugaa

SEQ ID NO: 140 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaauauggucuguaccagga

SEQ ID NO: 141 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauguauauacuuuagaccuc

SEQ ID NO: 142 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuaagcaaguuaaucacag

SEQ ID NO: 143 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaacuaagaagcuuuaucaa

SEQ ID NO: 144 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacccaagaagucuucacugg

SEQ ID NO: 145 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauauguuuaaguaaccgca

SEQ ID NO: 146 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaugcauccaguucagcaug

SEQ ID NO: 147 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaguuauugggagugaagag

SEQ ID NO: 148 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuccaagagcuccagcuua

SEQ ID NO: 149 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagucuucauucacagcuag

SEQ ID NO: 150 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauauaugaguccucaugua

SEQ ID NO: 151 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacagcuagauuacuagguu

SEQ ID NO: 152 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauucagagcaguauuucugu

SEQ ID NO: 153 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauuuggagaguucccgugaa

SEQ ID NO: 154 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagcagcucuugucugccug

SEQ ID NO: 155 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguacaacuaagaagcuuuau

SEQ ID NO: 156 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguauauacuuuagaccucg

SEQ ID NO: 157 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggauauugauauaaugcca

SEQ ID NO: 158 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagcuuagaguccaggcuu

SEQ ID NO: 159 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauuucuguaggaaaucacac

SEQ ID NO: 160 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacugugaucauaguuuguu

SEQ ID NO: 161 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaacuacccaagaagucuuc

SEQ ID NO: 162 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcaaguuaaucacaggcua

SEQ ID NO: 163 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguauauacuuuagaccucgg

SEQ ID NO: 164 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcgcuggucgcccgcgcag

SEQ ID NO: 165 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauuugguagauaaggaacug

SEQ ID NO: 166 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaacagaacagaaaccagg

SEQ ID NO: 167 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauggaaccucuccgcggg

SEQ ID NO: 168 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcuuuacccauccacagca

SEQ ID NO: 169 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuaaagguucacuuuccuug

SEQ ID NO: 170 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaccagugguauugucugac

SEQ ID NO: 171 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauucagagcaguauuucug

SEQ ID NO: 172 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucagagcaguauuucuguag

SEQ ID NO: 173 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuuacaucacaugcuacaa

SEQ ID NO: 174 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaguaguauuaagaucugu

SEQ ID NO: 175 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucucugcaacaagaggcac

SEQ ID NO: 176 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauacauucgcaaaguucau

SEQ ID NO: 177 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucauauguuuaaguaaccgc

SEQ ID NO: 178 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaagaucugucagacaaguau

SEQ ID NO: 179 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuaucugaguccaauacaa

SEQ ID NO: 180 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaagaaccugcuucugacua

SEQ ID NO: 181 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaacuuguuuccgaaguuugg

SEQ ID NO: 182 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacaugcacacaugaccgcc

SEQ ID NO: 183 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacaagauucugucacacag

SEQ ID NO: 184 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augauggacugaaauggucug

SEQ ID NO: 185 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucagcugaggugacauggga

SEQ ID NO: 186 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaagcaaguuaaucacaggcu

SEQ ID NO: 187 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaauacuucguucauuugcu

SEQ ID NO: 188 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuugguagauaaggaacuga

SEQ ID NO: 189 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaguccaauacaagcaucuu

SEQ ID NO: 190 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauuuagagaaagacagcaa

SEQ ID NO: 191 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaaggccgacuccgggcug

SEQ ID NO: 192 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagacagacacacacaugca

SEQ ID NO: 193 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauuuagagaaagacagcaaa

SEQ ID NO: 194 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucguucauuugcucuuugcu

SEQ ID NO: 195 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacaauguuguucagaucug

SEQ ID NO: 196 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaccgcaguucucuguaggu

SEQ ID NO: 197 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caacagaacagaaaccaggug

SEQ ID NO: 198 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaugcuuaauacuucguucau

SEQ ID NO: 199 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaacagcccucucgacuug

SEQ ID NO: 200 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaucugcugaagcugguuaa

SEQ ID NO: 201 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acgcauaaucugcugaagcug

SEQ ID NO: 202 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacaauguucuuccagucaa

SEQ ID NO: 203 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaacagaacagaaaccaggu

SEQ ID NO: 204 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugcacacaugaccgccua

SEQ ID NO: 205 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaaguaaucauauuuagaga

SEQ ID NO: 206 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucugacauuucacaauguug

SEQ ID NO: 207 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacauuacuuacaucacaugc

SEQ ID NO: 208 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacacaugcacacacacuaa

SEQ ID NO: 209 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagaacuucagcagcugcag

SEQ ID NO: 210 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauggucuggagagcuucuu

SEQ ID NO: 211 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaauucucuuaucugaguc

SEQ ID NO: 212 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauugucugacauccuauacg

SEQ ID NO: 213 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacuucguucauuugcucuu

SEQ ID NO: 214 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccugcuucugacuacuggg

SEQ ID NO: 215 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaucauaggucaggcuuuu

SEQ ID NO: 216 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaaagguucacuuuccuuga

SEQ ID NO: 217 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauugucuuacccucccacaa

SEQ ID NO: 218 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacauccaccuguuccucu

SEQ ID NO: 219 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagguucugguaacgcucgg

SEQ ID NO: 220 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugacaucaagaaccugcuu

SEQ ID NO: 221 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguacauguaucacugcacug

SEQ ID NO: 222 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugacuuuauacuuucuuauua

SEQ ID NO: 223 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuccagcaagucgacagcc

SEQ ID NO: 224 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuuguuuccgaaguuuggg

SEQ ID NO: 225 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccugucagacgcauaaucug

SEQ ID NO: 226 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaguauuaagaucugucagac

SEQ ID NO: 227 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucugacauccuauacggca

SEQ ID NO: 228 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauuaagaucugucagacaag

SEQ ID NO: 229 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaggugauaucacuugccau

SEQ ID NO: 230 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugucuuguucagcuccugcc

SEQ ID NO: 231 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacugucugguuguaaugcau

SEQ ID NO: 232 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucccugcaccuucgccccu

SEQ ID NO: 233 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuguucauauugucuuaccc

SEQ ID NO: 234 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcucaaauagcaagacgug

SEQ ID NO: 235 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucucuucuuggucaaggggu

SEQ ID NO: 236 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccacagcaaagaccuggau

SEQ ID NO: 237 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcugguuaauauggucugu

SEQ ID NO: 238 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagaacgugggccucuccuga

SEQ ID NO: 239 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuguuaaugagauaagcgg

SEQ ID NO: 240 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacagucuucauucacagcu

SEQ ID NO: 241 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccgcaguucucuguagguu

SEQ ID NO: 242 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagcugaauguauauacuuu

SEQ ID NO: 243 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugaauauaguuucuugccu

SEQ ID NO: 244 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaauguuaggaguaguauua

SEQ ID NO: 245 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuaugcaucccacugaccaa

SEQ ID NO: 246 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaccaggaaacaauguucuuc

SEQ ID NO: 247 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuguucagagaaaucaggag

SEQ ID NO: 248 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuucagcucacagucuucau

SEQ ID NO: 249 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacguaucacugagggacggu

SEQ ID NO: 250 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuacuuacaucacaugcuac

SEQ ID NO: 251 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccaguucagcaugaucuca

SEQ ID NO: 252 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacugaacauggucaucugua

SEQ ID NO: 253 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauucaagaaaccucugcac

SEQ ID NO: 254 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caauacaagcaucuucuccag

SEQ ID NO: 255 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugacauuucacaauguuguuc

SEQ ID NO: 256 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaaagucacugugaucaua

SEQ ID NO: 257 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaugcaucccacugaccaaa

SEQ ID NO: 258 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaaucacaggcuagugcaca

SEQ ID NO: 259 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauaguuuguucauauuguc

SEQ ID NO: 260 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcagcuguccaacagcccu

SEQ ID NO: 261 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaucugagaaccauacuaa

SEQ ID NO: 262 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacuuuaaagguucacuuuc

SEQ ID NO: 263 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacacgagcauuuacaaccaa

SEQ ID NO: 264 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaagaagcuuuaucaacauuu

SEQ ID NO: 265 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaauacaagcaucuucucc

SEQ ID NO: 266 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuaucuacacuuucuucuc

SEQ ID NO: 267 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguacugagcaaaguaggca

SEQ ID NO: 268 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucuucggcaucugaguca

SEQ ID NO: 269 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaacugcaauaaaggagaug

SEQ ID NO: 270 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaggagcccuguaccaccua

SEQ ID NO: 271 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaauuugcccuuucucccca

SEQ ID NO: 272 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaggacuccaucucuucuug

SEQ ID NO: 273 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgaguguagauaagacaggc

SEQ ID NO: 274 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuuuacccauccacagcaa

SEQ ID NO: 275 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaucauugaauuccuccag

SEQ ID NO: 276 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuguaccaggaaacaauguu

SEQ ID NO: 277 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuggaguacauguaucacug

SEQ ID NO: 278 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagucaacagcucggccau

SEQ ID NO: 279 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaccaaacagguggugggc

SEQ ID NO: 280 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucagcagcugcagucuuuua

SEQ ID NO: 281 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuuugcauugaacauauuc

SEQ ID NO: 282 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaugacaucaagaaccugc

SEQ ID NO: 283 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguuugggauauuccuggga

SEQ ID NO: 284 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacgcaugugcucacaugcac

SEQ ID NO: 285 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggcugccugauuacuccgg

SEQ ID NO: 286 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauguuuaaguaaccgcagu

SEQ ID NO: 287 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagggacggugucaggucug

SEQ ID NO: 288 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggagagcuucuucacugcca

SEQ ID NO: 289 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucauauuuagagaaagacag

SEQ ID NO: 290 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuagcauuaguuauuggga

SEQ ID NO: 291 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugggaucuaaacuaccca

SEQ ID NO: 292 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcccggcucagaacuucag

SEQ ID NO: 293 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuuagcaggcuacaccaaa

SEQ ID NO: 294 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucaucuguaagcuucuga

SEQ ID NO: 295 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuccagcaagucgacagcca

SEQ ID NO: 296 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggacugaucauaaggaucgg

SEQ ID NO: 297 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggugaggauuugaacugcaa

SEQ ID NO: 298 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagacugaauauaguuucuug

SEQ ID NO: 299 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucuacacuuucuucucucc

SEQ ID NO: 300 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucugucagacaaguaugcca

SEQ ID NO: 301 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugggauguugucaagucua

SEQ ID NO: 302 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuguaagcuucugacauuu

SEQ ID NO: 303 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagagaggugauaucacuu

SEQ ID NO: 304 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauacuucguucauuugcucu

SEQ ID NO: 305 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaagauucugucacacagc

SEQ ID NO: 306 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucccucauucucucuuuug

SEQ ID NO: 307 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaacuuguuuccgaaguuu

SEQ ID NO: 308 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucauauugucuuacccuccc

SEQ ID NO: 309 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaaaggauauugauauaaug

SEQ ID NO: 310 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucaucuugcuguggauggu

SEQ ID NO: 311 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaguacacaggaaguacau

SEQ ID NO: 312 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaguaaucauauuuagagaa

SEQ ID NO: 313 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguucauauugucuuacccuc

SEQ ID NO: 314 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauuccuccagagaccuug

SEQ ID NO: 315 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaaagacagacacacacaug

SEQ ID NO: 316 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguugucaagucuacgcccca

SEQ ID NO: 317 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaaauacauucgcaaaguu

SEQ ID NO: 318 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugggccgcuguaauucucuu

SEQ ID NO: 319 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggaggaaaucucugcaacaa

SEQ ID NO: 320 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augacuucaucauaggucagg

SEQ ID NO: 321 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacuuacaucacaugcuaca

SEQ ID NO: 322 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaacacguauguggucacaug

SEQ ID NO: 323 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacuugagaaacucacuaaa

SEQ ID NO: 324 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguacaacuaagaagcuuua

SEQ ID NO: 325 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacauucucaaaggauuccu

SEQ ID NO: 326 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcuuaauacuucguucauu

SEQ ID NO: 327 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagacgcauaaucugcugaa

SEQ ID NO: 328 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaauaaacuugagaaacuca

SEQ ID NO: 329 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacuccgggcccacaagcag

SEQ ID NO: 330 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagcugaggugacaugggau

SEQ ID NO: 331 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcacugauugagaaauggaa

SEQ ID NO: 332 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgcaaaguucaucuucggca

SEQ ID NO: 333 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaaugauggacugaaauggu

SEQ ID NO: 334 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaauauaugaguccucaugu

SEQ ID NO: 335 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauauaguuucuugccuca

SEQ ID NO: 336 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaauagcaagacgugcaaa

SEQ ID NO: 337 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuccuccagagaccuugcag

SEQ ID NO: 338 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggauuccuacaauauacaa

SEQ ID NO: 339 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaauaucagcugaggugacau

SEQ ID NO: 340 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauggaaccucuccgcgggcg

SEQ ID NO: 341 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaguccucauguagaacaaa

SEQ ID NO: 342 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaggucugaagcaaccagaa

SEQ ID NO: 343 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauuccuccagagaccuugca

SEQ ID NO: 344 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gugguauugucugacauccua

SEQ ID NO: 345 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaugucagcugaauguauaua

SEQ ID NO: 346 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augacaucaagaaccugcuuc

SEQ ID NO: 347 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaucacaggcuagugcacag

SEQ ID NO: 348 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauucacagcuagauuacua

SEQ ID NO: 349 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guauauacuuuagaccucgga

SEQ ID NO: 350 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuuacacucgaguguagaua

SEQ ID NO: 351 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucccucuggaguacaugua

SEQ ID NO: 352 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccucugcaccaaaggugaa

SEQ ID NO: 353 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucauuugcucuuugcuuuac

SEQ ID NO: 354 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggucuguaccaggaaacaa

SEQ ID NO: 355 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacucucgcgagaacagcucc

SEQ ID NO: 356 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaacacgcacgcacacgcacg

SEQ ID NO: 357 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguugucaagucuacgcccc

SEQ ID NO: 358 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacauccaccuguuccucuu

SEQ ID NO: 359 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaagagcaagguggaggcu

SEQ ID NO: 360 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacucucagaaagaagagcaa

SEQ ID NO: 361 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauuucacaauguuguucag

SEQ ID NO: 362 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcuguggauggugaggauu

SEQ ID NO: 363 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacacaucauugaauuccucc

SEQ ID NO: 364 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuagcauuaguuauugggagu

SEQ ID NO: 365 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauuacuuacaucacaugcua

SEQ ID NO: 366 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguucaucuucggcaucuga

SEQ ID NO: 367 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguucuuccagucaacagcu

SEQ ID NO: 368 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaucucugcaacaagaggca

SEQ ID NO: 369 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaacugaacauggucaucugu

SEQ ID NO: 370 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggugaggauuugaacugca

SEQ ID NO: 371 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaguucagcaugaucucag

SEQ ID NO: 372 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacacgagcauuuacaacca

SEQ ID NO: 373 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuuucaaaggacugaucau

SEQ ID NO: 374 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagcaaccagaagguaugg

SEQ ID NO: 375 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauuuauggauacuggaauuu

SEQ ID NO: 376 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuccaguugacucaggggg

SEQ ID NO: 377 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagcugaugacuucaucaua

SEQ ID NO: 378 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaccagauacacaucauuga

SEQ ID NO: 379 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuucuuagcauuaguuauug

SEQ ID NO: 380 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaacagaccaaucacauuu

SEQ ID NO: 381 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauauguuuaaguaaccgcag

SEQ ID NO: 382 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaggaacugaacaugguca

SEQ ID NO: 383 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucacugagggacgguguca

SEQ ID NO: 384 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagcaauuucccucauucucu

SEQ ID NO: 385 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuauuuauggauacuggaau

SEQ ID NO: 386 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgugguacugagcaaaguag

SEQ ID NO: 387 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuucauucacagcuagauua

SEQ ID NO: 388 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuucuguaggaaaucacacg

SEQ ID NO: 389 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugccuccuuccuucuugcu

SEQ ID NO: 390 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaagaagagcaagguggag

SEQ ID NO: 391 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuugcuccaguugacucagg

SEQ ID NO: 392 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggacugaaauggucuggag

SEQ ID NO: 393 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugguuguaaugcauccagu

SEQ ID NO: 394 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaguucaucuucggcaucug

SEQ ID NO: 395 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuaacacgcacgcacacgca

SEQ ID NO: 396 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuauggauacuggaauuuaa

SEQ ID NO: 397 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggagugaagagaauaacuu

SEQ ID NO: 398 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augaguccucauguagaacaa

SEQ ID NO: 399 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacagaauagcacuaggggc

SEQ ID NO: 400 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagccugucauuucaucaucu

SEQ ID NO: 401 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagaaauggaaacaccuugg

SEQ ID NO: 402 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accuccuguaaagucacugug

SEQ ID NO: 403 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agauaaggaacugaacauggu

SEQ ID NO: 404 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacaacuaagaagcuuuauca

SEQ ID NO: 405 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagagcaggacaagcagcug

SEQ ID NO: 406 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caacacagaauagcacuaggg

SEQ ID NO: 407 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuugcauugaacauauuccu

SEQ ID NO: 408 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauaugaguccucauguag

SEQ ID NO: 409 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggauauugauauaaugccau

SEQ ID NO: 410 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuccaucucuucuuggucaa

SEQ ID NO: 411 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugcacacacacuaacacg

SEQ ID NO: 412 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaucugcugaagcugguua

SEQ ID NO: 413 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguuaaugagauaagcggggg

SEQ ID NO: 414 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucggcaucugagucaaagac

SEQ ID NO: 415 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggaaacaauguucuuccag

SEQ ID NO: 416 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucauucacagcuagauuacu

SEQ ID NO: 417 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguaaccgcaguucucugua

SEQ ID NO: 418 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaaauucagcaaguuaugaa

SEQ ID NO: 419 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugacauccuauacggcaua

SEQ ID NO: 420 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaugucagcugaauguauau

SEQ ID NO: 421 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacugagcaaaguaggcaugu

SEQ ID NO: 422 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agugguauugucugacauccu

SEQ ID NO: 423 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caagauucugucacacagcca

SEQ ID NO: 424 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gacaucaagaaccugcuucug

SEQ ID NO: 425 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucaaaggacugaucauaag

SEQ ID NO: 426 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauacuuuagaccucggaga

SEQ ID NO: 427 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucuuuauaaaguugaaaau

SEQ ID NO: 428 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugaguccaauacaagcauc

SEQ ID NO: 429 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuauacuuucuuauuacaca

SEQ ID NO: 430 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauacaagauucugucacac

SEQ ID NO: 431 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuucuccagcaagucgacag

SEQ ID NO: 432 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgcaugaaugauggacugaa

SEQ ID NO: 433 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucagcaugaucucaggagcc

SEQ ID NO: 434 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaagcuucugacauuucac

SEQ ID NO: 435 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaggaaguacaugacaucaa

SEQ ID NO: 436 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugacauuucacaauguugu

SEQ ID NO: 437 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugcaccaaaggugaagggu

SEQ ID NO: 438 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccuauacggcauaacugau

SEQ ID NO: 439 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augugcucacaugcacacaug

SEQ ID NO: 440 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accagugguauugucugacau

SEQ ID NO: 441 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuuucuuauuacacaaaag

SEQ ID NO: 442 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauguuguucagaucugcccc

SEQ ID NO: 443 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcauuaugcucagaaaccga

SEQ ID NO: 444 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaacacagaauagcacuagg

SEQ ID NO: 445 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaguuauugggagugaagaga

SEQ ID NO: 446 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccuucuugcuccaguugac

SEQ ID NO: 447 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucugcaacaagaggcacuu

SEQ ID NO: 448 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucucuucuuggucaagggg

SEQ ID NO: 449 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaauaaagaguacacagga

SEQ ID NO: 450 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugcucacaugcacacauga

SEQ ID NO: 451 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuguaaugcauccaguucagc

SEQ ID NO: 452 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucuggagagcuucuucac

SEQ ID NO: 453 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguuguucagaucugccccc

SEQ ID NO: 454 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagugacuuuauacuuucuua

SEQ ID NO: 455 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuaaauguuaggaguaguau

SEQ ID NO: 456 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gauugucuuguucagcuccug

SEQ ID NO: 457 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugagucaaagacugaauau

SEQ ID NO: 458 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucaaauauacugucaagau

SEQ ID NO: 459 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaggcacaaacauauuuaca

SEQ ID NO: 460 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaucaacugucugguuguaa

SEQ ID NO: 461 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agugaagagaauaacuuguuu

SEQ ID NO: 462 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acggugucaggucugaagcaa

SEQ ID NO: 463 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaggaguaguauuaagaucu

SEQ ID NO: 464 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accugcuucugacuacugggg

SEQ ID NO: 465 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caauauggaaccucuccgcgg

SEQ ID NO: 466 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaggaggucccugcuuucaa

SEQ ID NO: 467 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggauacuggaauuuaaguu

SEQ ID NO: 468 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucucuuaucugaguccaau

SEQ ID NO: 469 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacagcucccgggacucuccg

SEQ ID NO: 470 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuauaaggaggucccugcu

SEQ ID NO: 471 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagagcaugcagccuccua

SEQ ID NO: 472 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcuucugacauuucacaau

SEQ ID NO: 473 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucucaaaggauuccuacaa

SEQ ID NO: 474 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaaggacugaucauaagga

SEQ ID NO: 475 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacguauguggucacaugug

SEQ ID NO: 476 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucucaaaggauuccuacaau

SEQ ID NO: 477 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaucagcugaggugacaugg

SEQ ID NO: 478 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaaauggucuggagagcuuc

SEQ ID NO: 479 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgcgagaacagcucccggga

SEQ ID NO: 480 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcagcucuugucugccugag

SEQ ID NO: 481 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacuuuagaccucggagaau

SEQ ID NO: 482 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugaucauaguuuguucaua

SEQ ID NO: 483 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucacagcuagauuacuagg

SEQ ID NO: 484 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuacacuuucuucucuccuuu

SEQ ID NO: 485 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucaagaaaccucugcacca

SEQ ID NO: 486 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguuaggaguaguauuaagau

SEQ ID NO: 487 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggccgcuguaauucucuua

SEQ ID NO: 488 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaucugucagacaaguaug

SEQ ID NO: 489 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuugcuuuacccauccacagc

SEQ ID NO: 490 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucagaaagaagagcaaggu

SEQ ID NO: 491 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaaauaucaacugucuggu

SEQ ID NO: 492 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauguuaggaguaguauuaa

SEQ ID NO: 493 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaggaaaucacacgagcauuu

SEQ ID NO: 494 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagagaccuugcaggugua

SEQ ID NO: 495 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagaaacucacuaaauuuga

SEQ ID NO: 496 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuaagaagcuuuaucaacau

SEQ ID NO: 497 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacaucacaugcuacaaaau

SEQ ID NO: 498 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augccugaaauucagcaaguu

SEQ ID NO: 499 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaucauauuuagagaaagac

SEQ ID NO: 500 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagugggaucaacagaacaga

SEQ ID NO: 501 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agauugucuuguucagcuccu

SEQ ID NO: 502 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauuaugucagcugaauguau

SEQ ID NO: 503 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauuaugucagcugaaugu

SEQ ID NO: 504 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcucuuugcuuuacccauc

SEQ ID NO: 505 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucuuguucagcuccugccgg

SEQ ID NO: 506 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucaucuauaaggaggucccu

SEQ ID NO: 507 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuuuauuuauggauacugga

SEQ ID NO: 508 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacuuucuucucuccuuuua

SEQ ID NO: 509 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaggucccugugaauuauguc

SEQ ID NO: 510 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuagcauuaguuauugggag

SEQ ID NO: 511 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauacugucaagaucugaga

SEQ ID NO: 512 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcucuugucugccugagcca

SEQ ID NO: 513 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaagucacugugaucauagu

SEQ ID NO: 514 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagaaucuucagcucacag

SEQ ID NO: 515 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacaagcaucuucuccagca

SEQ ID NO: 516 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagucaauguuaagcugccaa

SEQ ID NO: 517 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuucuccagcaagucgaca

SEQ ID NO: 518 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaugacuucaucauaggucag

SEQ ID NO: 519 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucucuuaucugaguccaaua

SEQ ID NO: 520 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaucuucagcucacagucuu

SEQ ID NO: 521 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuagaccucggagaauuugg

SEQ ID NO: 522 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucgugguacugagcaaagua

SEQ ID NO: 523 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuguucagcuccugccgguag

SEQ ID NO: 524 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagaauaacuuguuuccgaa

SEQ ID NO: 525 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaccugcuucugacuacug

SEQ ID NO: 526 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augaaugauggacugaaaugg

SEQ ID NO: 527 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacccucccacaaagacaga

SEQ ID NO: 528 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caagaagucaauguuaagcug

SEQ ID NO: 529 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcuccugccgguagaacgug

SEQ ID NO: 530 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaagcaucuucuccagcaag

SEQ ID NO: 531 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucacugagggacggugucag

SEQ ID NO: 532 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuagagaaagacagcaaaag

SEQ ID NO: 533 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacgcaugugcucacaugca

SEQ ID NO: 534 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcauuuacaaccaaacaugg

SEQ ID NO: 535 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaaauauacugucaagauc

SEQ ID NO: 536 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaacuuguuuccgaaguuug

SEQ ID NO: 537 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagauauucaagaaaccucug

SEQ ID NO: 538 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauucgcaaaguucaucuuc

SEQ ID NO: 539 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauacaagcaucuucuccagc

SEQ ID NO: 540 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguucaacacagaauagcacu

SEQ ID NO: 541 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuauuuauggauacuggaauu

SEQ ID NO: 542 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugcaacaagaggcacuuga

SEQ ID NO: 543 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaagacugaauauaguuuc

SEQ ID NO: 544 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuucagcucacagucuuca

SEQ ID NO: 545 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucacaggcuagugcacaga

SEQ ID NO: 546 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacacuggaagugacuuuaua

SEQ ID NO: 547 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugucaagaucugagaaccau

SEQ ID NO: 548 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auugaauuccuccagagaccu

SEQ ID NO: 549 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacugcaauaaaggagaugag

SEQ ID NO: 550 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcauugaacauauuccuaaa

SEQ ID NO: 551 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagcucacagucuucauuca

SEQ ID NO: 552 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacacguauguggucacaugu

SEQ ID NO: 553 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagaaagaagagcaaggugg

SEQ ID NO: 554 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcuauacauccaccuguuc

SEQ ID NO: 555 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaaagacagacacacacau

SEQ ID NO: 556 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcaacaagaggcacuugaau

SEQ ID NO: 557 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagaaaccgaagagcucuuc

SEQ ID NO: 558 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccuccagagaccuugcagg

SEQ ID NO: 559 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacaggcuagugcacagaag

SEQ ID NO: 560 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagggagaaagagagacgca

SEQ ID NO: 561 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaccgaagagcucuuccaag

SEQ ID NO: 562 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaucuacacuuucuucucuc

SEQ ID NO: 563 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauaguuucuugccucaugg

SEQ ID NO: 564 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacgcacauauacgcaugug

SEQ ID NO: 565 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacaucauugaauuccucca

SEQ ID NO: 566 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagggcagggacgcgcuccgg

SEQ ID NO: 567 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaccaggaaacaauguucu

SEQ ID NO: 568 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaucuucagcucacagucu

SEQ ID NO: 569 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaagucaauguuaagcugc

SEQ ID NO: 570 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuucugacauuucacaauguu

SEQ ID NO: 571 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaggauuugaacugcaauaa

SEQ ID NO: 572 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugccugauuacuccgggccca

SEQ ID NO: 573 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauccuauacggcauaacug

SEQ ID NO: 574 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuugaauaauauuuggagag

SEQ ID NO: 575 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagacacacacaugcacaca

SEQ ID NO: 576 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauggaaccucuccgcgggc

SEQ ID NO: 577 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucgcccgcgcaggugcgg

SEQ ID NO: 578 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguaucacugcacugauuga

SEQ ID NO: 579 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucuucagcucacagucuuc

SEQ ID NO: 580 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauuacuuacaucacaugcu

SEQ ID NO: 581 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacgcacgcacacgcacgca

SEQ ID NO: 582 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucugagaaccauacuaagca

SEQ ID NO: 583 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcugaugacuucaucauag

SEQ ID NO: 584 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacagaacagaaaccaggugc

SEQ ID NO: 585 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaauacauucgcaaaguuc

SEQ ID NO: 586 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agugacuuuauacuuucuuau

SEQ ID NO: 587 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaucagcugaggugacaug

SEQ ID NO: 588 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacuaagcaaguuaaucaca

SEQ ID NO: 589 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaagaguacacaggaaguac

SEQ ID NO: 590 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggacuccaucucuucuuggu

SEQ ID NO: 591 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaccauggaggaaaucucu

SEQ ID NO: 592 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaauacauucgcaaaguuca

SEQ ID NO: 593 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacacucgaguguagauaaga

SEQ ID NO: 594 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacuuucuuauuacacaaaa

SEQ ID NO: 595 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugcuagaaauaaagaguac

SEQ ID NO: 596 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcauccaguucagcaugau

SEQ ID NO: 597 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcauuucuuagcauuaguua

SEQ ID NO: 598 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauguaucacugcacugauu

SEQ ID NO: 599 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaagcuuuaucaacauuuuc

SEQ ID NO: 600 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugaagcaaccagaagguau

SEQ ID NO: 601 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuucguucauuugcucuuug

SEQ ID NO: 602 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauuuggagaguucccguga

SEQ ID NO: 603 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugacauuucacaauguuguu

SEQ ID NO: 604 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcugagcccugucauuucgg

SEQ ID NO: 605 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuugaacugcaauaaaggaga

SEQ ID NO: 606 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuucggcaucugagucaaa

SEQ ID NO: 607 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuucaucauaggucaggcuu

SEQ ID NO: 608 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agucacugugaucauaguuug

SEQ ID NO: 609 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaccugccugacaccagggc

SEQ ID NO: 610 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaagcuuuaucaacauuuu

SEQ ID NO: 611 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuggaagugacuuuauacuu

SEQ ID NO: 612 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaucaagaaccugcuucuga

SEQ ID NO: 613 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauacugucaagaucugag

SEQ ID NO: 614 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugguagauaaggaacugaac

SEQ ID NO: 615 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaagaucugagaaccauacu

SEQ ID NO: 616 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuggagagcuucuucacugc

SEQ ID NO: 617 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggucuggagagcuucuuca

SEQ ID NO: 618 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaauauaguuucuugccuc

SEQ ID NO: 619 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuugcuguggauggugagga

SEQ ID NO: 620 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucacaauguuguucagaucu

SEQ ID NO: 621 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccacucaucuauaaggaggu

SEQ ID NO: 622 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaggaucgugguacugagca

SEQ ID NO: 623 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaagagcuccagcuuagag

SEQ ID NO: 624 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuauugggagugaagagaaua

SEQ ID NO: 625 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagguucugguaacgcucggg

SEQ ID NO: 626 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuaucugaguccaauacaagc

SEQ ID NO: 627 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuccagagaccuugcaggu

SEQ ID NO: 628 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcacuugaauaauauuugg

SEQ ID NO: 629 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaaaucucugcaacaagag

SEQ ID NO: 630 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caagaucugagaaccauacua

SEQ ID NO: 631 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacaugugcaaagaccuuua

SEQ ID NO: 632 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacagaaaccaggugcucagg

SEQ ID NO: 633 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauacgcaugugcucacaug

SEQ ID NO: 634 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacacacaugcacacacacu

SEQ ID NO: 635 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacagucuucauucacagcua

SEQ ID NO: 636 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucacugcacugauugagaaa

SEQ ID NO: 637 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaaucacauucucaaagga

SEQ ID NO: 638 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagagaauaacuuguuuccg

SEQ ID NO: 639 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auagcaauuucccucauucuc

SEQ ID NO: 640 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auugucuuguucagcuccugc

SEQ ID NO: 641 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagagacgcacauauacgca

SEQ ID NO: 642 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccagcugcugcgcccgcua

SEQ ID NO: 643 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucacaugcacacaugaccgc

SEQ ID NO: 644 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuguuuccgaaguuugggaua

SEQ ID NO: 645 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggucaccagauacacauca

SEQ ID NO: 646 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuacccauccacagcaaagac

SEQ ID NO: 647 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucagagaaaucaggagaugg

SEQ ID NO: 648 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugucuuacccucccacaaag

SEQ ID NO: 649 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagagcaguauuucuguagga

SEQ ID NO: 650 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuucccucauucucucuuuu

SEQ ID NO: 651 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucagcucacagucuucauuc

SEQ ID NO: 652 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guagauaaggaacugaacaug

SEQ ID NO: 653 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguaaccgcaguucucuguag

SEQ ID NO: 654 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauuucccucauucucucuuu

SEQ ID NO: 655 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcugucagccgcagcggcug

SEQ ID NO: 656 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucaggaucgugguacuga

SEQ ID NO: 657 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaauauacugucaagaucug

SEQ ID NO: 658 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugacaucaagaaccugcuucu

SEQ ID NO: 659 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaaaggacugaucauaagg

SEQ ID NO: 660 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauguggucacaugugcaaag

SEQ ID NO: 661 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacagcuagauuacuagguuu

SEQ ID NO: 662 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccugugaauuaugucagcu

SEQ ID NO: 663 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggcacaaacauauuuacag

SEQ ID NO: 664 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacggcauaacugauuacagc

SEQ ID NO: 665 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggaagugacuuuauacuuuc

SEQ ID NO: 666 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaccugaaguaucaauugu

SEQ ID NO: 667 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagcucuuccaagagcuccag

SEQ ID NO: 668 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucaagaucugagaaccaua

SEQ ID NO: 669 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucccacugaccaaauaucaa

SEQ ID NO: 670 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggaaccucuccgcgggcggg

SEQ ID NO: 671 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucacaauguuguucagauc

SEQ ID NO: 672 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agccugucauuucaucaucug

SEQ ID NO: 673 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagcaguauuucuguaggaa

SEQ ID NO: 674 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuuccuucuugcuccaguu

SEQ ID NO: 675 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugcaugcucaaauagcaag

SEQ ID NO: 676 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguacaugacaucaagaaccu

SEQ ID NO: 677 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguuucauauguuuaaguaa

SEQ ID NO: 678 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agauauucaagaaaccucugc

SEQ ID NO: 679 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucugaagcaaccagaaggua

SEQ ID NO: 680 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaaguuaaucacaggcuag

SEQ ID NO: 681 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagugacuuuauacuuucuu

SEQ ID NO: 682 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcacccgcacccucuccccg

SEQ ID NO: 683 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaggugaaggguaagcagag

SEQ ID NO: 684 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugguaacgcucgggcaccu

SEQ ID NO: 685 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcucagaaaccgaagagcuc

SEQ ID NO: 686 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagcucccgggacucuccga

SEQ ID NO: 687 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuauggauacuggaauuuaag

SEQ ID NO: 688 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaauaucaacugucugguug

SEQ ID NO: 689 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauaaggaggucccugcuuuc

SEQ ID NO: 690 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauaucaacugucugguugu

SEQ ID NO: 691 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccaggugcucaggacucca

SEQ ID NO: 692 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugucaagaucugagaacca

SEQ ID NO: 693 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagcaugaucucaggagccc

SEQ ID NO: 694 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaaccgaagagcucuuccaa

SEQ ID NO: 695 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaccauacuaagcaaguua

SEQ ID NO: 696 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggacugaaauggucuggaga

SEQ ID NO: 697 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaccugcuucugacuacugg

SEQ ID NO: 698 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuauacauccaccuguuccuc

SEQ ID NO: 699 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauguuaggaguaguauuaag

SEQ ID NO: 700 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucaggacuccaucucuucuu

SEQ ID NO: 701 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucacaggcuagugcacagaa

SEQ ID NO: 702 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauaaucugcugaagcugguu

SEQ ID NO: 703 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acucgaguguagauaagacag

SEQ ID NO: 704 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuucagcagcugcagucuuu

SEQ ID NO: 705 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaggcaugugcaagggcuugg

SEQ ID NO: 706 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguuaauauggucuguacca

SEQ ID NO: 707 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugggaucuaaacuacccaa

SEQ ID NO: 708 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugaucauaaggaucggcca

SEQ ID NO: 709 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacacacaugcacacacacua

SEQ ID NO: 710 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaacugucugguuguaaug

SEQ ID NO: 711 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuuacaucacaugcuacaaa

SEQ ID NO: 712 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcagcuguccaacagcccuc

SEQ ID NO: 713 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agugggaucaacagaacagaa

SEQ ID NO: 714 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaucaacagaacagaaaccag

SEQ ID NO: 715 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaucugagaaccauacuaag

SEQ ID NO: 716 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agguaugggccuucucuccgu

SEQ ID NO: 717 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaagaaaccucugcaccaaa

SEQ ID NO: 718 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacggcauaacugauuaca

SEQ ID NO: 719 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagguaugggccuucucuccg

SEQ ID NO: 720 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acucucgcgagaacagcuccc

SEQ ID NO: 721 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaguuucaaauauacuguca

SEQ ID NO: 722 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaacugucugguuguaaugc

SEQ ID NO: 723 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuaagaucugucagacaagu

SEQ ID NO: 724 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauauuuagagaaagacagc

SEQ ID NO: 725 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauucaagaaaccucugcacc

SEQ ID NO: 726 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucauaguuuguucauauugu

SEQ ID NO: 727 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagcaggacaagcagcugug

SEQ ID NO: 728 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguucagagaaaucaggagau

SEQ ID NO: 729 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucuuaucugaguccaauac

SEQ ID NO: 730 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgcccgcgcaggugcggcug

SEQ ID NO: 731 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggcuccaguggucgcgguu

SEQ ID NO: 732 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagagaaaucaggagauggg

SEQ ID NO: 733 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagagacgcacauauacgc

SEQ ID NO: 734 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagaacagaaaccaggugcuc

SEQ ID NO: 735 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agucaaagacugaauauaguu

SEQ ID NO: 736 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augggaucuaaacuacccaag

SEQ ID NO: 737 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggauacuggaauuuaaguuu

SEQ ID NO: 738 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagcucuuccaagagcucc

SEQ ID NO: 739 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaaggauuccuacaauaua

SEQ ID NO: 740 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggagaugaggccuuuacuu

SEQ ID NO: 741 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguucaucuucggcaucugag

SEQ ID NO: 742 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugcgucgcaguacucccguu

SEQ ID NO: 743 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguucaugaauacaaauaaa

SEQ ID NO: 744 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaugacuucaucauagguca

SEQ ID NO: 745 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauuuacaguuucaaauaua

SEQ ID NO: 746 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaaacuugagaaacucacu

SEQ ID NO: 747 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauggucuguaccaggaaa

SEQ ID NO: 748 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauauuuagagaaagacagca

SEQ ID NO: 749 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcuagugcacagaagccag

SEQ ID NO: 750 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagugaagugggaucaacag

SEQ ID NO: 751 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucuugcuguggaugguga

SEQ ID NO: 752 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaucauugaauuccuccaga

SEQ ID NO: 753 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauaguuucuugccucaug

SEQ ID NO: 754 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagagcaggacaagcagcu

SEQ ID NO: 755 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaaccgaagagcucuucca

SEQ ID NO: 756 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagucugccuccuuccuucu

SEQ ID NO: 757 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggcuagugcacagaagcca

SEQ ID NO: 758 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaaggauauugauauaaugc

SEQ ID NO: 759 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaauauacugucaagaucu

SEQ ID NO: 760 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacagguucugguaacgcuc

SEQ ID NO: 761 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucgcgagaacagcucccggg

SEQ ID NO: 762 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucuucggcaucugagucaa

SEQ ID NO: 763 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagcaaaguaggcaugugca

SEQ ID NO: 764 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guacauguaucacugcacuga

SEQ ID NO: 765 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugccgguagaacgugggccuc

SEQ ID NO: 766 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaagaaccugcuucugacu

SEQ ID NO: 767 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auguuuaaguaaccgcaguuc

SEQ ID NO: 768 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacauauuuacaguuucaaa

SEQ ID NO: 769 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagugggaucaacagaaca

SEQ ID NO: 770 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccugaagagagcaggacaag

SEQ ID NO: 771 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacacacacaugcacacaca

SEQ ID NO: 772 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagcugguuaauauggucu

SEQ ID NO: 773 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagaggugauaucacuugc

SEQ ID NO: 774 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugugaauuaugucagcugaa

SEQ ID NO: 775 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaagagcaagguggaggcug

SEQ ID NO: 776 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaugaucucaggagcccug

SEQ ID NO: 777 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccaaauaucaacugucugguu

SEQ ID NO: 778 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauaaagaguacacaggaag

SEQ ID NO: 779 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagcuccagcuuagagucca

SEQ ID NO: 780 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caccagauacacaucauugaa

SEQ ID NO: 781 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaacauauuuacaguuucaa

SEQ ID NO: 782 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacaagaggcacuugaauaau

SEQ ID NO: 783 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcuuaaauauaugaguccu

SEQ ID NO: 784 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaaggacugaucauaaggau

SEQ ID NO: 785 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaaagaccuggauacucuu

SEQ ID NO: 786 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuaaacuacccaagaaguc

SEQ ID NO: 787 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagcauuucuuagcauuagu

SEQ ID NO: 788 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagaccuggauacucuucac

SEQ ID NO: 789 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggauguugucaagucuacg

SEQ ID NO: 790 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaccuggauacucuucaccaa

SEQ ID NO: 791 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcagccuccuaacacguau

SEQ ID NO: 792 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuuguuuccgaaguuuggga

SEQ ID NO: 793 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucugguuguaaugcauccag

SEQ ID NO: 794 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagucacugugaucauaguuu

SEQ ID NO: 795 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugugcaugcucaaauagcaa

SEQ ID NO: 796 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucgcgguuccaagagcca

SEQ ID NO: 797 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guacguaucacugagggacgg

SEQ ID NO: 798 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauugaauuccuccagagac

SEQ ID NO: 799 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaguacacaggaaguacaug

SEQ ID NO: 800 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accauggaggaaaucucugca

SEQ ID NO: 801 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acguauguggucacaugugca

SEQ ID NO: 802 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaauauaguuucuugccucau

SEQ ID NO: 803 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuaaacuacccaagaagucu

SEQ ID NO: 804 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagcuagauuacuagguuuu

SEQ ID NO: 805 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccauacuaagcaaguuaau

SEQ ID NO: 806 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauacgcaugugcucacaugc

SEQ ID NO: 807 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaagcugaugacuucaucau

SEQ ID NO: 808 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaaacauauuuacaguuuca

SEQ ID NO: 809 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccaagagcuccagcuuaga

SEQ ID NO: 810 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaauaaagaguacacaggaa

SEQ ID NO: 811 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuauacggcauaacugauu

SEQ ID NO: 812 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaugggagcauuaugcucag

SEQ ID NO: 813 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguuuaaguaaccgcaguucu

SEQ ID NO: 814 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggacuccaucucuucuugg

SEQ ID NO: 815 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuaugucagcugaauguaua

SEQ ID NO: 816 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caccaauaaauacauucgcaa

SEQ ID NO: 817 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaaccucugcaccaaaggug

SEQ ID NO: 818 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaguaggcaugugcaagggc

SEQ ID NO: 819 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguuguaaugcauccaguuc

SEQ ID NO: 820 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggaucgugguacugagcaa

SEQ ID NO: 821 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuuaaagguucacuuuccuu

SEQ ID NO: 822 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuuuaaagguucacuuuccu

SEQ ID NO: 823 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accucggagaauuugguagau

SEQ ID NO: 824 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagcuccagcuuagagucc

SEQ ID NO: 825 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaucgugguacugagcaaa

SEQ ID NO: 826 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguauuucuguaggaaaucac

SEQ ID NO: 827 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacggcauaacugauuacag

SEQ ID NO: 828 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacaguuuaaaggauauuga

SEQ ID NO: 829 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccagaaucuucagcucaca

SEQ ID NO: 830 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucugcaacaagaggcacuug

SEQ ID NO: 831 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauacauucgcaaaguucauc

SEQ ID NO: 832 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcucaaauagcaagacgugc

SEQ ID NO: 833 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucauugaauuccuccagaga

SEQ ID NO: 834 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugugaucauaguuuguuca

SEQ ID NO: 835 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggacagcagcucuugucugc

SEQ ID NO: 836 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagucaaagacugaauauag

SEQ ID NO: 837 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agucuucauucacagcuagau

SEQ ID NO: 838 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaagacugcgcccgccgcga

SEQ ID NO: 839 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccgcaguacucucgcgaga

SEQ ID NO: 840 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guaccaggaaacaauguucuu

SEQ ID NO: 841 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaaaggagaugaggccuuu

SEQ ID NO: 842 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcaucuucuccagcaaguc

SEQ ID NO: 843 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauguauauacuuuagacc

SEQ ID NO: 844 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucagcugaauguauauacuu

SEQ ID NO: 845 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guguucaacacagaauagcac

SEQ ID NO: 846 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auugucuuacccucccacaaa

SEQ ID NO: 847 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacagcccucucgacuugccc

SEQ ID NO: 848 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaagaagcuuuaucaacauu

SEQ ID NO: 849 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaauaucagcugaggugaca

SEQ ID NO: 850 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcacacaugaccgccuaug

SEQ ID NO: 851 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagcccucucgacuugcccg

SEQ ID NO: 852 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccgaaguuugggauauuccu

SEQ ID NO: 853 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacccaauauggaaccucucc

SEQ ID NO: 854 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagcccugucauuucggcca

SEQ ID NO: 855 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuugagaaacucacuaaau

SEQ ID NO: 856 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauccaccuguuccucuuuu

SEQ ID NO: 857 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacuacccaagaagucuuca

SEQ ID NO: 858 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaagcagcugugcaugcuca

SEQ ID NO: 859 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaucauaaggaucggccac

SEQ ID NO: 860 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacucugcuagaaauaaagag

SEQ ID NO: 861 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguaaugcauccaguucagca

SEQ ID NO: 862 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagucaauguuaagcugcca

SEQ ID NO: 863 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaagguggaggcugcccug

SEQ ID NO: 864 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuacccaagaagucuucacug

SEQ ID NO: 865 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcauccacaaccuccuguaa

SEQ ID NO: 866 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucuugcuguggauggugag

SEQ ID NO: 867 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucucugcaacaagaggcacu

SEQ ID NO: 868 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuaaauauaugaguccucau

SEQ ID NO: 869 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccuccuuccuucuugcuccag

SEQ ID NO: 870 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguaggcaugugcaagggcu

SEQ ID NO: 871 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagucugccuccuuccuucuu

SEQ ID NO: 872 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucuguaccaggaaacaau

SEQ ID NO: 873 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaggacaagcagcugugca

SEQ ID NO: 874 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaccucugcaccaaagguga

SEQ ID NO: 875 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augggccuucucuccgugcca

SEQ ID NO: 876 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucggagaauuugguagauaag

SEQ ID NO: 877 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggaacugaacauggucauc

SEQ ID NO: 878 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaucauaguuuguucauauu

SEQ ID NO: 879 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuccagcaagucgacagccag

SEQ ID NO: 880 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaccaagaagucaauguuaa

SEQ ID NO: 881 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaauauuuggagaguuccc

SEQ ID NO: 882 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caguucagcaugaucucagga

SEQ ID NO: 883 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaugcauccaguucagcauga

SEQ ID NO: 884 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuguaagcuucugacauuuc

SEQ ID NO: 885 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacuaacacgcacgcacacg

SEQ ID NO: 886 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaucacacgagcauuuacaa

SEQ ID NO: 887 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gugcucaggacuccaucucuu

SEQ ID NO: 888 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagaauuugguagauaaggaa

SEQ ID NO: 889 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuccgagagccgagauuuua

SEQ ID NO: 890 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaaacuacccaagaagucuu

SEQ ID NO: 891 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuuuaaagguucacuuucc

SEQ ID NO: 892 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacucacuaaauuugaaaaa

SEQ ID NO: 893 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuggaagugacuuuauacuuu

SEQ ID NO: 894 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acucucagaaagaagagcaag

SEQ ID NO: 895 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugaauuaugucagcugaau

SEQ ID NO: 896 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagaacagaaaccaggugcu

SEQ ID NO: 897 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcaaagaccuuuauuacaaa

SEQ ID NO: 898 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacacgcacgcacacgcacgc

SEQ ID NO: 899 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguucagcaugaucucaggag

SEQ ID NO: 900 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacccucccacaaagacagac

SEQ ID NO: 901 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacuuuagaccucggagaauu

SEQ ID NO: 902 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccugucagacgcauaaucu

SEQ ID NO: 903 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucacacgagcauuuacaac

SEQ ID NO: 904 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcugccugauuacuccggg

SEQ ID NO: 905 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccacugaccaaauaucaacug

SEQ ID NO: 906 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugagcaaaguaggcaugug

SEQ ID NO: 907 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucucgcgagaacagcucccg

SEQ ID NO: 908 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccuguuaaugagauaagcg

SEQ ID NO: 909 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuguuaaugagauaagcgggg

SEQ ID NO: 910 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaguuuaaaggauauugau

SEQ ID NO: 911 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugacaucaagaaccugcu

SEQ ID NO: 912 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccacagcaaagaccuggaua

SEQ ID NO: 913 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaaccaagaagucaauguua

SEQ ID NO: 914 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuugcuuuacccauccacag

SEQ ID NO: 915 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacugucaagaucugagaac

SEQ ID NO: 916 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugaccaaauaucaacuguc

SEQ ID NO: 917 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcucaggacuccaucucuuc

SEQ ID NO: 918 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauugggagugaagagaauaa

SEQ ID NO: 919 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuucuugcuccaguugacuca

SEQ ID NO: 920 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaaggagaugaggccuuua

SEQ ID NO: 921 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augugcaagggcuugggccgc

SEQ ID NO: 922 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcugguuaauauggucugua

SEQ ID NO: 923 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaacuucagcagcugcaguc

SEQ ID NO: 924 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacagacacacacaugcaca

SEQ ID NO: 925 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaagauucugucacacagcc

SEQ ID NO: 926 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agucugccuccuuccuucuug

SEQ ID NO: 927 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcaauaaaggagaugaggcc

SEQ ID NO: 928 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuguaggaaaucacacgagc

SEQ ID NO: 929 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uggucacaugugcaaagaccu

SEQ ID NO: 930 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaucuucuccagcaagucg

SEQ ID NO: 931 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcaugcucaaauagcaagac

SEQ ID NO: 932 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugagaaccauacuaagcaag

SEQ ID NO: 933 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuagaaauaaagaguacacag

SEQ ID NO: 934 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucugagucaaagacugaaua

SEQ ID NO: 935 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaaccucugcaccaaaggu

SEQ ID NO: 936 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugugaucauaguuuguucau

SEQ ID NO: 937 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugaacauggucaucuguaa

SEQ ID NO: 938 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacaauguucuuccagucaac

SEQ ID NO: 939 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucuguaagcuucugacauu

SEQ ID NO: 940 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaaccugcuucugacuacu

SEQ ID NO: 941 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuccaccauggaggaaaucuc

SEQ ID NO: 942 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagugaagagaauaacuuguu

SEQ ID NO: 943 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagaggugauaucacuugcc

SEQ ID NO: 944 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guucaacacagaauagcacua

SEQ ID NO: 945 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucauugaauuccuccagag

SEQ ID NO: 946 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcauuucuuagcauuaguu

SEQ ID NO: 947 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccagcugcugcgcccgcuaa

SEQ ID NO: 948 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccuccuguaaagucacugu

SEQ ID NO: 949 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucucaggagcccuguaccac

SEQ ID NO: 950 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaagggcagggacgcgcuccg

SEQ ID NO: 951 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuguccaacagcccucucgac

SEQ ID NO: 952 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuaagcaaguuaaucacagg

SEQ ID NO: 953 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagguucacuuuccuugaaa

SEQ ID NO: 954 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gacagcagcucuugucugccu

SEQ ID NO: 955 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuuauggauacuggaauuua

SEQ ID NO: 956 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccugcuuucaaaggacuga

SEQ ID NO: 957 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugguuguaaugcauccaguu

SEQ ID NO: 958 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuucuugcuccaguugacu

SEQ ID NO: 959 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacugagggacggugucagg

SEQ ID NO: 960 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaacagaaaccaggugcuca

SEQ ID NO: 961 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucagagcaguauuucuguagg

SEQ ID NO: 962 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguuuguucauauugucuuac

SEQ ID NO: 963 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguguagauaagacaggcccc

SEQ ID NO: 964 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauugugcauuaaauaaaaa

SEQ ID NO: 965 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuuagagaaagacagcaaaa

SEQ ID NO: 966 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauggucaucuguaagcuuc

SEQ ID NO: 967 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugccugaaauucagcaaguua

SEQ ID NO: 968 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguagauaaggaacugaaca

SEQ ID NO: 969 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugacuucaucauaggucaggc

SEQ ID NO: 970 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guacucucgcgagaacagcuc

SEQ ID NO: 971 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauacaagauucugucacaca

SEQ ID NO: 972 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagaggugauaucacuugcca

SEQ ID NO: 973 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauguucuuccagucaacagc

SEQ ID NO: 974 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacugaauauaguuucuugc

SEQ ID NO: 975 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucaaauagcaagacgugcaa

SEQ ID NO: 976 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagguggaggcugcccuggag

SEQ ID NO: 977 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaggcuuccagagcaugca

SEQ ID NO: 978 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaugcucagaaaccgaagagc

SEQ ID NO: 979 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaaccugccugacaccaggg

SEQ ID NO: 980 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acccaauauggaaccucuccg

SEQ ID NO: 981 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucacugugaucauaguuugu

SEQ ID NO: 982 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacauucucaaaggauuccua

SEQ ID NO: 983 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggugaaggguaagcagaga

SEQ ID NO: 984 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucaucaggaucgugguac

SEQ ID NO: 985 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaacauggucaucuguaag

SEQ ID NO: 986 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agugaagugggaucaacagaa

SEQ ID NO: 987 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucgaguguagauaagacagg

SEQ ID NO: 988 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugacaugggaucuaaacuacc

SEQ ID NO: 989 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacacuaacacgcacgcacac

SEQ ID NO: 990 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuacccaagaagucuucac

SEQ ID NO: 991 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gauaaggaacugaacaugguc

SEQ ID NO: 992 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccaauauggaaccucuccgcg

SEQ ID NO: 993 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauaugaguccucauguaga

SEQ ID NO: 994 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacugaccaaauaucaacugu

SEQ ID NO: 995 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggccuucucuccgugccac

SEQ ID NO: 996 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cgcaguucucuguagguucuu

SEQ ID NO: 997 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagccuccuaacacguaugug

SEQ ID NO: 998 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guguagauaagacaggcccca

SEQ ID NO: 999 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaggugcucaggacuccau

SEQ ID NO: 1000 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacauccucacucugcuagaa

SEQ ID NO: 1001 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caagcagcugugcaugcucaa

SEQ ID NO: 1002 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaggauauugauauaaugcc

SEQ ID NO: 1003 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caguuucaaauauacugucaa

SEQ ID NO: 1004 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcccucucgacuugcccgg

SEQ ID NO: 1005 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagagcaggacaagcagcugu

SEQ ID NO: 1006 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcugaauguauauacuuua

SEQ ID NO: 1007 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuaucugaguccaauacaag

SEQ ID NO: 1008 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augcucagaaaccgaagagcu

SEQ ID NO: 1009 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caacugucugguuguaaugca

SEQ ID NO: 1010 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaauaaauacauucgcaaa

SEQ ID NO: 1011 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaugauggacugaaauggucu

SEQ ID NO: 1012 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuggaguacauguaucacugc

SEQ ID NO: 1013 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcaccaaaggugaaggguaa

SEQ ID NO: 1014 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacauucgcaaaguucaucu

SEQ ID NO: 1015 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaucucuucuuggucaagg

SEQ ID NO: 1016 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaauuaugucagcugaaugua

SEQ ID NO: 1017 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaggaggucccugcuuuca

SEQ ID NO: 1018 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaggccuuuacuuuaaaggu

SEQ ID NO: 1019 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuugcuguggauggugagg

SEQ ID NO: 1020 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaguuugggauauuccuggg

SEQ ID NO: 1021 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagucugcugagcccugucau

SEQ ID NO: 1022 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaagcagcuguccaacagcc

SEQ ID NO: 1023 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagaaaccaggugcucagga

SEQ ID NO: 1024 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggugcucaggacuccaucuc

SEQ ID NO: 1025 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaccuccuguaaagucacug

SEQ ID NO: 1026 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucacaugugcaaagaccuuu

SEQ ID NO: 1027 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggauuccuacaauauacaaa

SEQ ID NO: 1028 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauggucuggagagcuucuuc

SEQ ID NO: 1029 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuucggcaucugagucaaag

SEQ ID NO: 1030 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acgcacacgcacgcacacccc

SEQ ID NO: 1031 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcucacagucuucauucac

SEQ ID NO: 1032 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gauguugucaagucuacgccc

SEQ ID NO: 1033 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucggcaucugagucaaagacu

SEQ ID NO: 1034 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguuccugucagacgcauaau

SEQ ID NO: 1035 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucucaaaggauuccuacaaua

SEQ ID NO: 1036 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaacgugggccucuccugag

SEQ ID NO: 1037 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acguccaacagaccaaucaca

SEQ ID NO: 1038 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acucuuacacucgaguguaga

SEQ ID NO: 1039 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcgucgcaguacucccguuc

SEQ ID NO: 1040 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuggagacagguucugguaa

SEQ ID NO: 1041 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucagaaagaagagcaaggug

SEQ ID NO: 1042 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaaguaggcaugugcaaggg

SEQ ID NO: 1043 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugcagccuccuaacacgua

SEQ ID NO: 1044 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucucccugcaccuucgcccc

SEQ ID NO: 1045 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guucuuccagucaacagcucg

SEQ ID NO: 1046 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcugaagcugguuaauaugg

SEQ ID NO: 1047 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcacaaacauauuuacagu

SEQ ID NO: 1048 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuccuguaaagucacugugau

SEQ ID NO: 1049 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaagagaauaacuuguuucc

SEQ ID NO: 1050 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucaacugucugguuguaau

SEQ ID NO: 1051 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauugucuuacccucccaca

SEQ ID NO: 1052 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguuaaucacaggcuagugca

SEQ ID NO: 1053 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgggcaccucccagauuguc

SEQ ID NO: 1054 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaggugacaugggaucuaaa

SEQ ID NO: 1055 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagcugguuaauauggucug

SEQ ID NO: 1056 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcugaauguauauacuuuag

SEQ ID NO: 1057 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccuguuaaugagauaagcggg

SEQ ID NO: 1058 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uagaguccaggcuuccagagc

SEQ ID NO: 1059 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaaccuccuguaaagucacu

SEQ ID NO: 1060 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucuucuccagcaagucgac

SEQ ID NO: 1061 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagaaccauacuaagcaaguu

SEQ ID NO: 1062 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcaugaucucaggagcccu

SEQ ID NO: 1063 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuguaaagucacugugauc

SEQ ID NO: 1064 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacauauuuacaguuucaaau

SEQ ID NO: 1065 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagagaggugauaucacuug

SEQ ID NO: 1066 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucuggagagcuucuucacug

SEQ ID NO: 1067 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guuguaaugcauccaguucag

SEQ ID NO: 1068 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaugcacacaugaccgccu

SEQ ID NO: 1069 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaccgccuaugaaggcugcc

SEQ ID NO: 1070 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguaggcaugugcaagggcuu

SEQ ID NO: 1071 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caauguucuuccagucaacag

SEQ ID NO: 1072 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaacacgcacgcacacgcac

SEQ ID NO: 1073 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccauggaggaaaucucugcaa

SEQ ID NO: 1074 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucugcuagaaauaaagagua

SEQ ID NO: 1075 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caacagaccaaucacauuuuc

SEQ ID NO: 1076 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguacucucgcgagaacagcu

SEQ ID NO: 1077 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guccaauacaagcaucuucuc

SEQ ID NO: 1078 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagacgcacauauacgcaug

SEQ ID NO: 1079 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcuguccaacagcccucucg

SEQ ID NO: 1080 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuuauuuauggauacuggaa

SEQ ID NO: 1081 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggaaccucuccgcgggcgg

SEQ ID NO: 1082 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagcaaaguaggcaugugcaa

SEQ ID NO: 1083 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggcuacaccaaacaggugg

SEQ ID NO: 1084 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccgaaguuugggauauuccug

SEQ ID NO: 1085 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguggucacaugugcaaagac

SEQ ID NO: 1086 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucugcugaagcugguuaau

SEQ ID NO: 1087 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcaggcuacaccaaacaggug

SEQ ID NO: 1088 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuguaaagucacugugaucau

SEQ ID NO: 1089 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaggaucgugguacugagc

SEQ ID NO: 1090 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuaaaggauauugauauaau

SEQ ID NO: 1091 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaccucggagaauuugguag

SEQ ID NO: 1092 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaccaaauaucaacugucugg

SEQ ID NO: 1093 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugugcaaagaccuuuauu

SEQ ID NO: 1094 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaguuuaaaggauauugaua

SEQ ID NO: 1095 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguaaucauauuuagagaaa

SEQ ID NO: 1096 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucagucugccuccuuccuuc

SEQ ID NO: 1097 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagagcaagguggaggcugcc

SEQ ID NO: 1098 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcucuugucugccugagccaa

SEQ ID NO: 1099 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaccuggauacucuucacc

SEQ ID NO: 1100 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauacuaagcaaguuaaucac

SEQ ID NO: 1101 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuacccauccacagcaaaga

SEQ ID NO: 1102 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucacucugcuagaaauaaaga

SEQ ID NO: 1103 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaugcacacacacuaacac

SEQ ID NO: 1104 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucuuugcuuuacccauccac

SEQ ID NO: 1105 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguggauggugaggauuugaa

SEQ ID NO: 1106 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gauuugaacugcaauaaagga

SEQ ID NO: 1107 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauggauacuggaauuuaagu

SEQ ID NO: 1108 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accgccuaugaaggcugccug

SEQ ID NO: 1109 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguuaaucacaggcuagugc

SEQ ID NO: 1110 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaugacuucaucauagguc

SEQ ID NO: 1111 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugcaaagaccuuuauuaca

SEQ ID NO: 1112 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaacucacuaaauuugaaa

SEQ ID NO: 1113 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucuuccaagagcuccagcuu

SEQ ID NO: 1114 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guaguauuaagaucugucaga

SEQ ID NO: 1115 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagagacgcacauauacgcau

SEQ ID NO: 1116 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuuagaccucggagaauuug

SEQ ID NO: 1117 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cgagcauuuacaaccaaacau

SEQ ID NO: 1118 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccagauugucuuguucagc

SEQ ID NO: 1119 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacacuaacacgcacgcaca

SEQ ID NO: 1120 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acaugaccgccuaugaaggcu

SEQ ID NO: 1121 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacaggaaguacaugacauc

SEQ ID NO: 1122 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauauugucuuacccucccac

SEQ ID NO: 1123 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcaucuucuccagcaagucga

SEQ ID NO: 1124 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccugccgguagaacgugggc

SEQ ID NO: 1125 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ggaacugaacauggucaucug

SEQ ID NO: 1126 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagcagcugugcaugcucaaa

SEQ ID NO: 1127 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccgcuguaauucucuuaucug

SEQ ID NO: 1128 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaugaguccucauguagaaca

SEQ ID NO: 1129 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguuucaaauauacugucaag

SEQ ID NO: 1130 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugcacacacacuaacacgc

SEQ ID NO: 1131 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augaccgccuaugaaggcugc

SEQ ID NO: 1132 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaauguuguucagaucugc

SEQ ID NO: 1133 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaguuaaucacaggcuagug

SEQ ID NO: 1134 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauccuauacggcauaacuga

SEQ ID NO: 1135 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagcauuuacaaccaaacaug

SEQ ID NO: 1136 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaauguauauacuuuagaccu

SEQ ID NO: 1137 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaccaggugcucaggacucc

SEQ ID NO: 1138 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaauuucccucauucucuc

SEQ ID NO: 1139 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagcaaccagaagguauggg

SEQ ID NO: 1140 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauauacgcaugugcucaca

SEQ ID NO: 1141 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accagauacacaucauugaau

SEQ ID NO: 1142 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaccuggauacucuucacca

SEQ ID NO: 1143 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccguuccagcugcugcgcc

SEQ ID NO: 1144 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucccacaaagacagacacaca

SEQ ID NO: 1145 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauaguuuguucauauugucu

SEQ ID NO: 1146 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagaggcacuugaauaauauu

SEQ ID NO: 1147 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaaguacaugacaucaaga

SEQ ID NO: 1148 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaugggccuucucuccgugcc

SEQ ID NO: 1149 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggcuacaccaaacagguggu

SEQ ID NO: 1150 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaucugucagacaaguaugc

SEQ ID NO: 1151 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcagccuccuaacacguaug

SEQ ID NO: 1152 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaugaaggcugccugauuacu

SEQ ID NO: 1153 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccuaacacguauguggucac

SEQ ID NO: 1154 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cccauccacagcaaagaccug

SEQ ID NO: 1155 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagaguacacaggaaguaca

SEQ ID NO: 1156 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gugucaggucugaagcaacca

SEQ ID NO: 1157 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cguauguggucacaugugcaa

SEQ ID NO: 1158 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugggccucuccugagacauuu

SEQ ID NO: 1159 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acagucugcugagcccuguca

SEQ ID NO: 1160 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuguuuccgaaguuugggau

SEQ ID NO: 1161 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauaauauuuggagaguuc

SEQ ID NO: 1162 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cgcuguaauucucuuaucuga

SEQ ID NO: 1163 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucugguaacgcucgggcacc

SEQ ID NO: 1164 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccacaaccuccuguaaaguc

SEQ ID NO: 1165 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuaugcucagaaaccgaaga

SEQ ID NO: 1166 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ggucacaugugcaaagaccuu

SEQ ID NO: 1167 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuauacauccaccuguucc

SEQ ID NO: 1168 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugguucaucaucaggaucgu

SEQ ID NO: 1169 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucaggaucgugguacugag

SEQ ID NO: 1170 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauucucaaaggauuccuac

SEQ ID NO: 1171 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcuccagcuuagaguccagg

SEQ ID NO: 1172 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucgcaguacucccguuccag

SEQ ID NO: 1173 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccauccacagcaaagaccugg

SEQ ID NO: 1174 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugugcaagggcuugggccgcu

SEQ ID NO: 1175 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacuggagacagguucuggua

SEQ ID NO: 1176 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugucagcugaauguauauacu

SEQ ID NO: 1177 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accgaagagcucuuccaagag

SEQ ID NO: 1178 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaccagaagguaugggccuu

SEQ ID NO: 1179 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuuaauacuucguucauuu

SEQ ID NO: 1180 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guucauuugcucuuugcuuua

SEQ ID NO: 1181 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaacauggucaucuguaagcu

SEQ ID NO: 1182 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucaggagaugggagcauuau

SEQ ID NO: 1183 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccugucauuucaucaucugug

SEQ ID NO: 1184 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcuucugacauuucacaaug

SEQ ID NO: 1185 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugcacugauugagaaaugg

SEQ ID NO: 1186 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagcucuuccaagagcucca

SEQ ID NO: 1187 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagaacuucagcagcugcagu

SEQ ID NO: 1188 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaggcacuugaauaauauuu

SEQ ID NO: 1189 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguccaacagcccucucgacu

SEQ ID NO: 1190 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaagcaaguuaaucacaggc

SEQ ID NO: 1191 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guaaugcauccaguucagcau

SEQ ID NO: 1192 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caggucugaagcaaccagaag

SEQ ID NO: 1193 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caauuucccucauucucucuu

SEQ ID NO: 1194 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaaggcuccaguggucgcgg

SEQ ID NO: 1195 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacgggagccucccgcagua

SEQ ID NO: 1196 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagauugucuuguucagcucc

SEQ ID NO: 1197 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaaaucacacgagcauuua

SEQ ID NO: 1198 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ggcauaacugauuacagccaa

SEQ ID NO: 1199 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuuggagaguucccgugaaa

SEQ ID NO: 1200 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaaucucugcaacaagaggc

SEQ ID NO: 1201 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guaacgcucgggcaccuccca

SEQ ID NO: 1202 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guauuaagaucugucagacaa

SEQ ID NO: 1203 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggauuugaacugcaauaaag

SEQ ID NO: 1204 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guacugagcaaaguaggcaug

SEQ ID NO: 1205 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacgagcauuuacaaccaaa

SEQ ID NO: 1206 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acgcacauauacgcaugugcu

SEQ ID NO: 1207 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagaaacucacuaaauuugaa

SEQ ID NO: 1208 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caagcagcuguccaacagccc

SEQ ID NO: 1209 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agagaaaucaggagaugggag

SEQ ID NO: 1210 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugggagugaagagaauaacu

SEQ ID NO: 1211 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuaguuauugggagugaaga

SEQ ID NO: 1212 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaaauggucuggagagcuu

SEQ ID NO: 1213 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcauuaguuauugggaguga

SEQ ID NO: 1214 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccaagaagucaauguuaag

SEQ ID NO: 1215 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augaucucaggagcccuguac

SEQ ID NO: 1216 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccucacucugcuagaaaua

SEQ ID NO: 1217 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccaguggucgcgguuccaag

SEQ ID NO: 1218 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acucccguuccagcugcugcg

SEQ ID NO: 1219 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agggacggugucaggucugaa

SEQ ID NO: 1220 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauauuuacaguuucaaauau

SEQ ID NO: 1221 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcaccugaaguaucaauugug

SEQ ID NO: 1222 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaguccaauacaagcaucuuc

SEQ ID NO: 1223 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagcauuaugcucagaaaccg

SEQ ID NO: 1224 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugucagacgcauaaucugcu

SEQ ID NO: 1225 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaaacagguggugggccag

SEQ ID NO: 1226 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gguuaauauggucuguaccag

SEQ ID NO: 1227 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cacaugugcaaagaccuuuau

SEQ ID NO: 1228 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acguaucacugagggacggug

SEQ ID NO: 1229 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccugccugacaccagggcc

SEQ ID NO: 1230 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaucacauucucaaaggauuc

SEQ ID NO: 1231 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acacaugcacacacacuaaca

SEQ ID NO: 1232 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guucacuuuccuugaaagggg

SEQ ID NO: 1233 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaacagaaaccaggugcucag

SEQ ID NO: 1234 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugauugagaaauggaaacacc

SEQ ID NO: 1235 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuucaucauaggucaggcuuu

SEQ ID NO: 1236 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcaucugagucaaagacugaa

SEQ ID NO: 1237 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguauuaagaucugucagaca

SEQ ID NO: 1238 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcugcccgcccagccgggc

SEQ ID NO: 1239 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucacagugaagugggaucaa

SEQ ID NO: 1240 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugcacacaugaccgccuau

SEQ ID NO: 1241 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggaacugaacauggucaucu

SEQ ID NO: 1242 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuuacaguuucaaauauacu

SEQ ID NO: 1243 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gacacacacaugcacacacac

SEQ ID NO: 1244 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccagauugucuuguucagcuc

SEQ ID NO: 1245 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucauaggucaggcuuuuc

SEQ ID NO: 1246 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcgcuggucgcccgcgcagg

SEQ ID NO: 1247 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccaggaaacaauguucuucca

SEQ ID NO: 1248 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aggucugaagcaaccagaagg

SEQ ID NO: 1249 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gagcuccagcuuagaguccag

SEQ ID NO: 1250 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugcuagaaauaaagaguacac

SEQ ID NO: 1251 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agcaggcuacaccaaacaggu

SEQ ID NO: 1252 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaggacugaucauaaggaucg

SEQ ID NO: 1253 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caaugcuuaauacuucguuca

SEQ ID NO: 1254 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagagaaaucaggagauggga

SEQ ID NO: 1255 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuuccuucuugcuccaguuga

SEQ ID NO: 1256 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuacaccaaacaggugguggg

SEQ ID NO: 1257 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gucagacgcauaaucugcuga

SEQ ID NO: 1258 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cagcagcucuugucugccuga

SEQ ID NO: 1259 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaugaguccucauguagaac

SEQ ID NO: 1260 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuugcuccaguugacucaggg

SEQ ID NO: 1261 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugcugaagcugguuaauau

SEQ ID NO: 1262 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cucccagauugucuuguucag

SEQ ID NO: 1263 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucacauucucaaaggauucc

SEQ ID NO: 1264 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaagugggaucaacagaacag

SEQ ID NO: 1265 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ccaaauacaagauucugucac

SEQ ID NO: 1266 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uccggcgcucaagacugcgcc

SEQ ID NO: 1267 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uguacguaucacugagggacg

SEQ ID NO: 1268 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguacacaggaaguacaugac

SEQ ID NO: 1269 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagagagacgcacauauacg

SEQ ID NO: 1270 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugugcucacaugcacacau

SEQ ID NO: 1271 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauggucuguaccaggaaaca

SEQ ID NO: 1272 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugcacugauugagaaaugga

SEQ ID NO: 1273 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauaguuucuugcagacucug

SEQ ID NO: 1274 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuucuugcagacucugaggag

SEQ ID NO: 1275 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uacauucgcaaaguucaucuu

SEQ ID NO: 1276 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaguuucuugcagacucugag

SEQ ID NO: 1277 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuuauaucauaaccaauucaa

SEQ ID NO: 1278 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauauggucaacuuacccag

SEQ ID NO: 1279 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucgcaaaguucaucuucggc

SEQ ID NO: 1280 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaagacugaauauaguuucuu

SEQ ID NO: 1281 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucgcaaaguucaucuucgg

SEQ ID NO: 1282 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauauggucaacuuacccagg

SEQ ID NO: 1283 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaucuucggcaucugaguc

SEQ ID NO: 1284 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acugaauauaguuucuugcag

SEQ ID NO: 1285 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaggauauauggucaacuua

SEQ ID NO: 1286 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauggucaacuuacccagggg

SEQ ID NO: 1287 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaacucuucuucaaaucccca

SEQ ID NO: 1288 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaauacauucgcaaaguucau

SEQ ID NO: 1289 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaccaauucaauauccaugag

SEQ ID NO: 1290 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auuuauaucauaaccaauuca

SEQ ID NO: 1291 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaguuucuugcagacucuga

SEQ ID NO: 1292 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucaauauccaugaggugagg

SEQ ID NO: 1293 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauaguuucuugcagacucu

SEQ ID NO: 1294 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauggucaacuuacccaggg

SEQ ID NO: 1295 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaugguacuuuauuuggucaa

SEQ ID NO: 1296 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uuauaucauaaccaauucaau

SEQ ID NO: 1297 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaucuucggcaucugaguca

SEQ ID NO: 1298 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aagacugaauauaguuucuug

SEQ ID NO: 1299 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaugguacuuuauuugguca

SEQ ID NO: 1300 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauaucauaaccaauucaaua

SEQ ID NO: 1301 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauaaauacauucgcaaaguu

SEQ ID NO: 1302 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acuaaugguacuuuauuuggu

SEQ ID NO: 1303 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucuugcagacucugaggaga

SEQ ID NO: 1304 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucgcaaaguucaucuucggca

SEQ ID NO: 1305 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaccaauucaauauccauga

SEQ ID NO: 1306 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaacuaaugguacuuuauuu

SEQ ID NO: 1307 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaguucaucuucggcaucuga

SEQ ID NO: 1308 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaccaauucaauauccaug

SEQ ID NO: 1309 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaauauccaugaggugagga

SEQ ID NO: 1310 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uugcagacucugaggagauuu

SEQ ID NO: 1311 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aaaguucaucuucggcaucug

SEQ ID NO: 1312 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucauaaccaauucaauaucca

SEQ ID NO: 1313 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uucggcaucugagucaaagac

SEQ ID NO: 1314 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auggucaacuuacccagggga

SEQ ID NO: 1315 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucugagucaaagacugaauau

SEQ ID NO: 1316 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaucauaaccaauucaauauc

SEQ ID NO: 1317 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
acauucgcaaaguucaucuuc

SEQ ID NO: 1318 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caauucaauauccaugaggug

SEQ ID NO: 1319 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucaaagacugaauauaguuuc

SEQ ID NO: 1320 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaauauaguuucuugcagac

SEQ ID NO: 1321 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augaggugaggauauaugguc

SEQ ID NO: 1322 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuugcagacucugaggagau

SEQ ID NO: 1323 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaaauacauucgcaaaguuc

SEQ ID NO: 1324 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uaaauacauucgcaaaguuca

SEQ ID NO: 1325 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucuucggcaucugagucaaa

SEQ ID NO: 1326 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aacuaaugguacuuuauuugg

SEQ ID NO: 1327 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauucaauauccaugagguga

SEQ ID NO: 1328 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auucaauauccaugaggugag

SEQ ID NO: 1329 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
uauccaugaggugaggauaua

SEQ ID NO: 1330 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauaguuucuugcagacuc

SEQ ID NO: 1331 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugaggugaggauauaugguca

SEQ ID NO: 1332 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cauaaccaauucaauauccau

SEQ ID NO: 1333 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agucaaagacugaauauaguu

SEQ ID NO: 1334 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agaaacucuucuucaaauccc

SEQ ID NO: 1335 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguucaucuucggcaucugag

SEQ ID NO: 1336 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caucuucggcaucugagucaa

SEQ ID NO: 1337 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
guuucuugcagacucugagga

SEQ ID NO: 1338 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caccaauaaauacauucgcaa

SEQ ID NO: 1339 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauacauucgcaaaguucauc

SEQ ID NO: 1340 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auaucauaaccaauucaauau

SEQ ID NO: 1341 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugagucaaagacugaauauag

SEQ ID NO: 1342 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aguuucuugcagacucugagg

SEQ ID NO: 1343 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaauucaauauccaugagg

SEQ ID NO: 1344 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gauauauggucaacuuaccca

SEQ ID NO: 1345 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucugagucaaagacugaaua

SEQ ID NO: 1346 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cugaauauaguuucuugcaga

SEQ ID NO: 1347 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caugaggugaggauauauggu

SEQ ID NO: 1348 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
agacugaauauaguuucuugc

SEQ ID NO: 1349 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
accaauaaauacauucgcaaa

SEQ ID NO: 1350 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auacauucgcaaaguucaucu

SEQ ID NO: 1351 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucuucggcaucugagucaaag

SEQ ID NO: 1352 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ucggcaucugagucaaagacu

SEQ ID NO: 1353 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauuuauaucauaaccaauuc

SEQ ID NO: 1354 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aauauccaugaggugaggaua

SEQ ID NO: 1355 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaggugaggauauauggucaa

SEQ ID NO: 1356 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auauccaugaggugaggauau

SEQ ID NO: 1357 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
augguacuuuauuuggucaaa

SEQ ID NO: 1358 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
caacuaaugguacuuuauuug

SEQ ID NO: 1359 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gaaacucuucuucaaaucccc

SEQ ID NO: 1360 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
aucauaaccaauucaauaucc

SEQ ID NO: 1361 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
auccaugaggugaggauauau

SEQ ID NO: 1362 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
cuaaugguacuuuauuugguc

SEQ ID NO: 1363 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
gcaucugagucaaagacugaa

SEQ ID NO: 1364 - RNA, 21 nt, Artificial Sequence
  source 1..21: /mol_type="RNA" /note="siRNA specific for mRNA encoding Mapk14" /organism="Artificial Sequence"
  ncRNA 1..21: /ncRNA_class="siRNA"
ugguacuuuauuuggucaaaa

SEQ ID NO: 1365 - RNA, 4353 nt, Homo sapiens
  source 1..4353: /mol_type="mRNA" /organism="Homo sapiens"
  mRNA 1..4353: /db_xref="GenBank:NM_001315" /function="mitogen-activated protein kinase 14"
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauuaaccagcuucagcagauuaugcgucugacaggaacaccccccgcuuaucucauuaacaggaugccaagccaugaggcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 1366 - RNA, 4353 nt, Homo sapiens
  source 1..4353: /mol_type="mRNA" /note="mitogen-activated protein kinase 14" /organism="Homo sapiens"
  mRNA 1..4353: /db_xref="GenBank:NM_139012" /function="mitogen-activated protein kinase 14"
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 1367 - RNA, 1431 nt, Homo sapiens
  source 1..1431: /mol_type="mRNA" /note="mitogen-activated protein kinase 14 " /organism="Homo sapiens"
  mRNA 1..1431: /function="mitogen-activated protein kinase 14"
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggguaaguugaccauauauccucaccucauggauauugaauugguuaugauauaaauuggggauuugaagaagaguuucuccuuuugaccaaauaaaguaccauuaguuga

SEQ ID NO: 1368 - RNA, 4274 nt, Homo sapiens
  source 1..4274: /mol_type="mRNA" /note="mitogen-activated protein kinase 14 " /organism="Homo sapiens"
  mRNA 1..4274: /db_xref="GenBank:NM_139014" /function="mitogen-activated protein kinase 14"
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucucugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 1369 - protein, 11 aa, artificial sequences
  SOURCE 1..11: /mol_type="protein" /note="JIP-1(153-163)" /organism="artificial sequences"
  NON_STD 11: "NH2-AcOH"
RPKRPTTLNLF

SEQ ID NO: 1370 - RNA, 22 nt, artificial sequences
  source 1..22: /mol_type="RNA" /note="Mapk14.1095" /organism="artificial sequences"
  ncRNA 1..22: /ncRNA_class="siRNA"
uacauuugcgaaguucaucuuc

SEQ ID NO: 1371 - RNA, 22 nt, artificial sequences
  source 1..22: /mol_type="RNA" /note="Mapk14.2590" /organism="artificial sequences"
  ncRNA 1..22: /ncRNA_class="siRNA"
uugagaaagauaguaaaggagc

The invention claimed is:

1. A pharmaceutical composition comprising Sorafenib and an inhibitor of the activity of Mapk14 for use as a medicament in the treatment or prevention of liver cancer, wherein the inhibitor is selected from the group consisting of Skepinone,

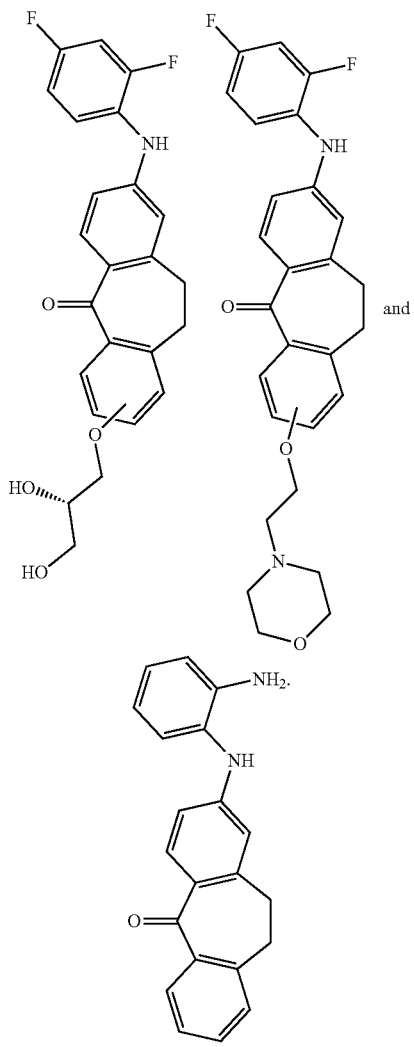

2. The pharmaceutical composition according to claim 1, wherein the inhibitor has an IC50 for Mapk14 of at maximum 30 nM.

3. The pharmaceutical composition according to claim 1, wherein Sorafenib is contained in a formulation for administration separate from a formulation containing the inhibitor of the activity of Mapk14.

4. The pharmaceutical composition according to claim 1, wherein Sorafenib and the inhibitor of the activity of Mapk14 are contained in one composition.

5. A pharmaceutical combination for the treatment of or prevention of liver cancer comprising: a pharmaceutical formulation comprising an inhibitor of the activity of Mapk14 and a separate pharmaceutical formulation comprising Sorafenib, wherein the inhibitor is selected from the group consisting of Skepinone,

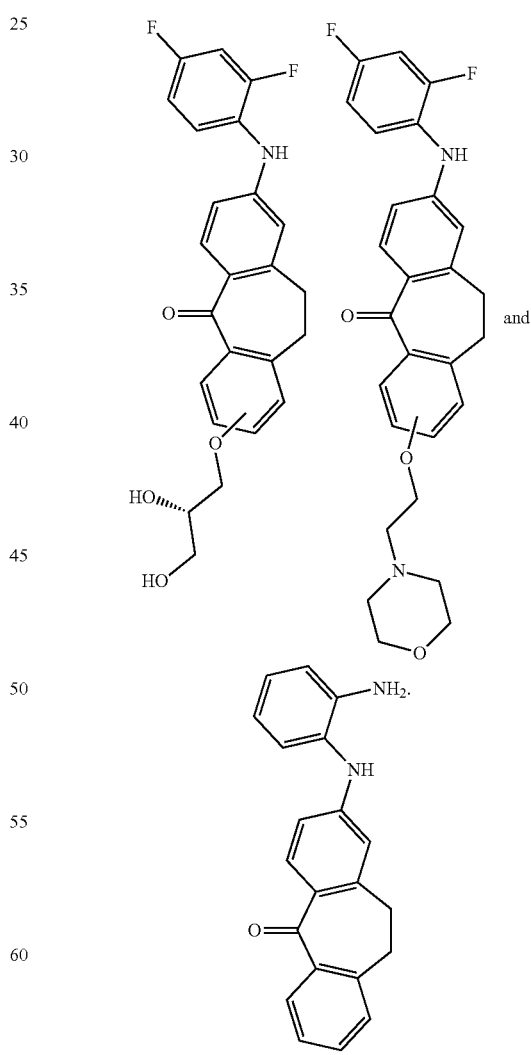

6. The pharmaceutical combination according to claim 5, wherein the pharmaceutical formulation comprising an inhibitor of the activity of Mapk14 is for administration separate from the administration of the pharmaceutical formulation comprising Sorafenib for the treatment or prevention of liver cancer for administration to a patient, wherein the inhibitor is selected from the group consisting of Skepinone,

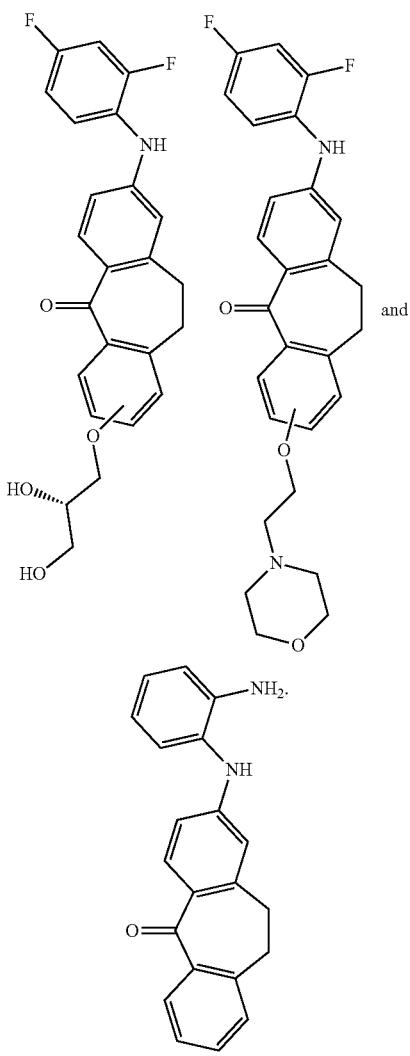

7. A method for treatment or prevention of liver cancer comprising administration of an inhibitor of the activity of Mapk14 in combination with Sorafenib, wherein the inhibitor is selected from the group consisting of Skepinone,

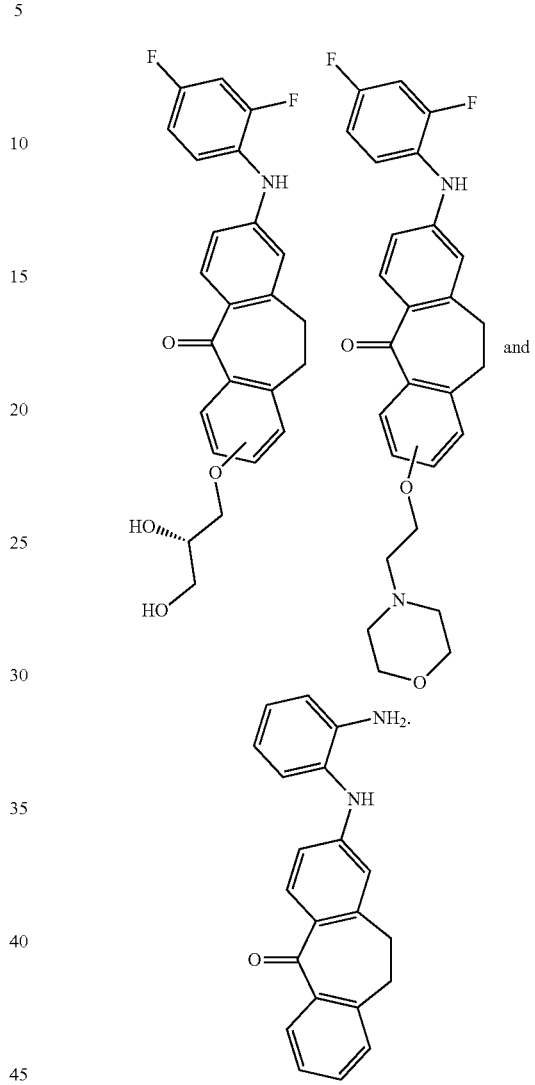

* * * * *